US012714744B2

(12) United States Patent
Patel et al.

(10) Patent No.: US 12,714,744 B2
(45) Date of Patent: Aug. 25, 2026

(54) CORONAVIRUS AND INFLUENZA COMPOSITIONS AND METHODS FOR USING THEM

(71) Applicant: Novavax, Inc., Gaithersburg, MD (US)

(72) Inventors: Nita Patel, Gaithersburg, MD (US); Bin Zhou, Clarksburg, MD (US); Mimi Guebre-Xabier, Gaithersburg, MD (US); Jing-Hui Tian, Germantown, MD (US); Alyse D. Portnoff, Gaithersburg, MD (US); Michael J. Massare, Mt. Airy, MD (US); Vivek Shinde, Gaithersburg, MD (US); Louis Fries, Ellicott City, MD (US); Gale Smith, Germantown, MD (US)

( * ) Notice: Subject to any disclaimer, the term of this patent is extended or adjusted under 35 U.S.C. 154(b) by 1113 days.

(21) Appl. No.: 17/736,452

(22) Filed: May 4, 2022

(65) Prior Publication Data

US 2022/0354944 A1 Nov. 10, 2022

Related U.S. Application Data

(60) Provisional application No. 63/332,537, filed on Apr. 19, 2022, provisional application No. 63/255,685, filed on Oct. 14, 2021, provisional application No. 63/193,356, filed on May 26, 2021, provisional application No. 63/184,727, filed on May 5, 2021.

(51) Int. Cl.

| | |
|---|---|
| *A61K 39/145* | (2006.01) |
| *A61K 9/51* | (2006.01) |
| *A61K 39/00* | (2006.01) |
| *A61K 39/215* | (2006.01) |
| *A61P 31/16* | (2006.01) |

(52) U.S. Cl.
CPC .............. *A61K 39/145* (2013.01); *A61K 9/51* (2013.01); *A61K 39/215* (2013.01); *A61P 31/16* (2018.01); *A61K 2039/55577* (2013.01); *A61K 2039/70* (2013.01)

(58) Field of Classification Search
CPC ...... A61K 39/145; A61K 9/51; A61K 39/215; A61K 2039/55577; A61K 2039/70; A61K 9/0019; A61K 9/5169; A61K 2039/55555; A61K 39/12; A61K 39/295; A61K 2039/545; A61K 2039/60; A61P 31/16; A61P 31/14; C12N 2760/16134; C12N 2760/16234; C12N 2770/20034
See application file for complete search history.

(56) References Cited

U.S. PATENT DOCUMENTS

| | | | | |
|---|---|---|---|---|
| 4,900,549 | A | 2/1990 | De Vries et al. | |
| 5,057,540 | A | 10/1991 | Kensil et al. | |
| 5,149,650 | A | 9/1992 | Wertz et al. | |
| 5,620,690 | A | 4/1997 | Kersten et al. | |
| 6,231,859 | B1 | 5/2001 | Kensil | |
| 6,245,532 | B1 | 6/2001 | Smith et al. | |
| 6,352,697 | B1 | 3/2002 | Cox et al. | |
| 6,428,807 | B1 | 8/2002 | Macfarlan et al. | |
| 6,524,584 | B2 | 2/2003 | Kensil | |
| 6,558,670 | B1 | 5/2003 | Friede et al. | |
| 6,846,489 | B1 | 1/2005 | Garcon et al. | |
| 7,776,343 | B1 | 8/2010 | Cox et al. | |
| 8,173,141 | B2 | 5/2012 | Cox et al. | |
| 8,541,003 | B2 | 9/2013 | Anderson et al. | |
| 8,563,002 | B2 | 10/2013 | Baudoux et al. | |
| 8,715,692 | B2 | 5/2014 | Pushko et al. | |
| 8,821,881 | B2 | 9/2014 | Morein et al. | |
| 9,675,685 | B2 | 6/2017 | Pushko et al. | |
| 9,708,373 | B2 | 7/2017 | Garcia-Sastre et al. | |
| 10,022,437 | B2 | 7/2018 | Pushko et al. | |
| 10,426,829 | B2 | 10/2019 | Smith et al. | |
| 10,729,764 | B2 | 8/2020 | Morein et al. | |
| 10,906,944 | B2 | 2/2021 | He et al. | |
| 10,953,089 | B1 * | 3/2021 | Smith | A61K 39/215 |
| 2004/0028698 | A1 | 2/2004 | Colau et al. | |
| 2005/0142148 | A1 | 6/2005 | Fouchier et al. | |
| 2006/0121065 | A1 | 6/2006 | Morein et al. | |
| 2006/0171917 | A1 | 8/2006 | Campbell et al. | |

(Continued)

FOREIGN PATENT DOCUMENTS

| | | |
|---|---|---|
| AU | 2003245220 B2 | 4/2009 |
| AU | 2014100888 A4 | 9/2014 |

(Continued)

OTHER PUBLICATIONS

Peacock, T.P., Goldhill, D.H., Zhou, J. et al. The furin cleavage site in the SARS-CoV-2 spike protein is required for transmission in ferrets. Nat Microbiol 6, 899-909 (2021). (Year: 2021).*
Wrapp D, Wang N, Corbett KS, Goldsmith JA, Hsieh CL, Abiona O, Graham BS, Mclellan JS. Cryo-EM structure of the 2019-nCoV spike in the prefusion conformation. Science. Mar. 13, 2020;367(6483):1260-1263. (Year: 2020).*
Hsieh et al 2020. Structure-based design of prefusion-stabilized SARS-CoV-2 spikes. Science. Sep. 18, 2020;369(6510):1501-1505. (Year: 2020).*

(Continued)

*Primary Examiner* — Bennett M Celsa
*Assistant Examiner* — Samadhan Jaising Jadhao
(74) *Attorney, Agent, or Firm* — Carlson, Caspers, Vandenburgh & Lindquist, P.A.

(57) ABSTRACT

Disclosed herein are compositions and methods for inducing immune responses against both influenza and coronaviruses. Provided herein are compositions and methods of using the same, wherein the compositions comprise: (a) a coronavirus S (CoV S) glycoprotein in the form of a detergent-core nanoparticle, wherein the detergent is a non-ionic detergent; (b) at least three hemagglutinin (HA) glycoproteins, wherein each HA glycoprotein is from a different influenza strain; and (c) a pharmaceutically acceptable buffer.

29 Claims, 52 Drawing Sheets

Specification includes a Sequence Listing.

(56) References Cited

U.S. PATENT DOCUMENTS

| | | | |
|---|---|---|---|
| 2006/0239963 A1 | 10/2006 | Morein et al. | |
| 2010/0017904 A1 | 1/2010 | Abad et al. | |
| 2010/0239617 A1 | 9/2010 | Pushko et al. | |
| 2010/0239671 A1 | 9/2010 | Edelman et al. | |
| 2010/0285135 A1 | 11/2010 | Wendorf et al. | |
| 2010/0291147 A1 | 11/2010 | Baudoux et al. | |
| 2012/0107353 A1 | 5/2012 | Morein et al. | |
| 2013/0122032 A1 | 5/2013 | Smith et al. | |
| 2013/0123333 A1 | 5/2013 | Mirkin et al. | |
| 2013/0337005 A1 | 12/2013 | Rademacher et al. | |
| 2014/0227309 A1 | 8/2014 | Smith et al. | |
| 2014/0294879 A1 | 10/2014 | Pushko et al. | |
| 2014/0335049 A1 | 11/2014 | Morein et al. | |
| 2015/0202283 A1 | 7/2015 | Steff et al. | |
| 2015/0209425 A1 | 7/2015 | Morein et al. | |
| 2015/0265698 A1 | 9/2015 | Pushko et al. | |
| 2015/0266930 A1 | 9/2015 | Pushko et al. | |
| 2015/0306207 A1 | 10/2015 | Smith et al. | |
| 2015/0335730 A1 | 11/2015 | Smith et al. | |
| 2015/0359872 A1 | 12/2015 | Pushko et al. | |
| 2016/0008451 A1 | 1/2016 | Stary et al. | |
| 2016/0046675 A1 | 2/2016 | Kwong | |
| 2016/0184427 A1 | 6/2016 | Morein et al. | |
| 2016/0206729 A1 | 7/2016 | Smith et al. | |
| 2017/0202948 A1 * | 7/2017 | Smith | A61P 31/16 |
| 2018/0133308 A1 | 5/2018 | Smith et al. | |
| 2018/0346521 A1 | 12/2018 | Langedijk | |
| 2018/0369368 A1 | 12/2018 | Morein et al. | |
| 2019/0314487 A1 * | 10/2019 | Boddapati | A61K 9/51 |
| 2020/0061185 A1 | 2/2020 | Graham et al. | |
| 2020/0101151 A1 | 4/2020 | Smith et al. | |
| 2020/0215189 A1 | 7/2020 | Morein et al. | |
| 2020/0345840 A1 | 11/2020 | Morein et al. | |
| 2020/0407402 A1 | 12/2020 | He et al. | |
| 2021/0139543 A1 | 5/2021 | He et al. | |
| 2021/0228708 A1 | 7/2021 | Smith et al. | |
| 2021/0228709 A1 | 7/2021 | Smith et al. | |
| 2021/0246170 A1 | 8/2021 | Langedijk et al. | |
| 2024/0277830 A1 * | 8/2024 | Rauch | A61K 47/26 |

FOREIGN PATENT DOCUMENTS

| | | | | |
|---|---|---|---|---|
| AU | 2022270082 A1 | 11/2023 | | |
| BR | 112016006122 B1 * | 11/2023 | A61K 39/215 | |
| BR | 1120230230357 A2 | 1/2024 | | |
| CA | 2491457 C | 9/2012 | | |
| CA | 3217591 A1 | 11/2022 | | |
| CN | 1472332 A | 2/2004 | | |
| CN | 101090711 A | 12/2007 | | |
| CN | 102107003 A | 6/2011 | | |
| CN | 112480217 A * | 3/2021 | A61K 9/5123 | |
| CN | 112546211 A * | 3/2021 | A61P 11/00 | |
| CN | 113185613 A * | 7/2021 | C07K 14/005 | |
| EP | 0109942 A2 | 5/1984 | | |
| EP | 0242380 B1 | 4/1991 | | |
| EP | 0180564 B1 | 7/1991 | | |
| EP | 0436620 B1 | 8/1994 | | |
| EP | 0362279 B1 | 1/1995 | | |
| EP | 0889736 B1 | 12/2003 | | |
| EP | 1539231 B1 | 6/2009 | | |
| EP | 4333885 A1 | 3/2024 | | |
| IL | 308180 A | 1/2024 | | |
| JP | 2014504634 A | 2/2014 | | |
| JP | 2023568063 | 5/2022 | | |
| JP | 2023533772 A | 8/2023 | | |
| MX | a2023013081 | 5/2022 | | |
| RU | 2403063 C1 | 11/2010 | | |
| RU | 2685185 C2 | 4/2019 | | |
| TW | 202308685 A | 3/2023 | | |
| WO | WO-8809336 A1 | 12/1988 | | |
| WO | WO-9003184 A1 | 4/1990 | | |
| WO | WO-9611711 A1 | 4/1996 | | |
| WO | WO-9730728 A1 | 8/1997 | | |
| WO | WO-9836772 A1 | 8/1998 | | |
| WO | WO-20010066137 A1 | 9/2001 | | |
| WO | WO-2004004762 A1 | 1/2004 | | |
| WO | WO-2004085633 A1 | 10/2004 | | |
| WO | WO-2005002620 A1 | 1/2005 | | |
| WO | WO-2005080417 A2 | 9/2005 | | |
| WO | WO-2007149490 A1 | 12/2007 | | |
| WO | WO-2009081285 A2 | 7/2009 | | |
| WO | WO-2010077717 A1 | 7/2010 | | |
| WO | WO-2010138193 A2 | 12/2010 | | |
| WO | WO-2012061815 A2 | 5/2012 | | |
| WO | WO-2013049342 A1 | 4/2013 | | |
| WO | WO-2014024024 A1 | 2/2014 | | |
| WO | WO-2014124423 A1 | 8/2014 | | |
| WO | WO-2014174018 A1 | 10/2014 | | |
| WO | WO-2015042373 A1 | 3/2015 | | |
| WO | WO-2017041100 A2 | 3/2017 | | |
| WO | WO-2018081318 A1 | 5/2018 | | |
| WO | WO-2018170347 A1 | 9/2018 | | |
| WO | WO-2019183063 A1 | 9/2019 | | |
| WO | WO-2021154763 A1 | 8/2021 | | |
| WO | WO-2021154812 A1 | 8/2021 | | |
| WO | WO-2021155323 A1 | 8/2021 | | |
| WO | WO-2021211760 A1 * | 10/2021 | C07K 14/165 | |
| WO | WO-2022046634 | 3/2022 | | |

OTHER PUBLICATIONS

McCallum M, Walls AC, Bowen JE, Corti D, Veesler D. Structure-guided covalent stabilization of coronavirus spike glycoprotein trimers in the closed conformation. Nat Struct Mol Biol. Oct. 2020;27(10):942-949. (Year: 2020).*

Kirchdoerfer et al 2016. Pre-fusion structure of a human coronavirus spike protein. Nature 531, 118-121 (2016). (Year: 2016).*

Schrader and Torkehagen 2020 (Vaxess Technologies, published on line Sep. 15, 2020, https://www.medigenvac.com/en/news_view.php?id=98) (Year: 2020).*

Fox 4 Now 2021 (YouTube, video Combination flu and COVID vaccine possible, video uploaded by Fox 4 Now on Feb. 24, 2021) (Year: 2021).*

Sekiya et al 2019. Inactivated whole virus particle vaccine with potent immunogenicity and limited IL-6 induction is ideal for influenza. Vaccine. Apr. 3, 2019;37(15):2158-2166. (Year: 2019).*

Massare, M. J., Patel, N., Zhou, B., Maciejewski, S., Flores, R., Guebre-Xabier, M., . . . & Smith, G. (2021). Combination respiratory vaccine containing recombinant SARS-CoV-2 spike and quadrivalent seasonal influenza hemagglutinin nanoparticles with matrix-M adjuvant. bioRxiv, May 2021. (Year: 2021).*

International Search Report and Written Opinion for International Application No. PCT/US2022/027465 dated Aug. 10, 2022, 11 pages.

Massare et al. Combination respiratory vaccine containing recombinant SARS-CoV-2 spike 1-8 and quadrivalent seasonal influenza hemagglutinin nanoparticles with matrix-m adjuvant. BioRxiv. May 5, 2021, pp. 1-27, [online][Retrieved on Jul. 15, 2022]. Retrieved from the internet: <url: <a="href=https://www.biorxiv.org/content/biorxiv/early/2021/05/05/2021.05.05.442782.full.pdf">https://www.biorxiv.org/content/biorxiv/early/2021/05/05/2021.05.05.442782.full.pdf full document.</url:>.

"Safety Evaluation of Certain Food Additives and Contaminants Quillaia Extracts," WHO Food Additives Series:48, 14 pages (1996).

Ahlberg et al., Global transcriptional response to ISCOM-Matrix adjuvant at the site of administration and in the draining lymph node early after intramuscular injection in pigs, Developmental and Comparative Immunology, vol. 38, pp. 17-26 (2012), Elsevier Ltd.

Anonymous, "Novavax to Present at the 2013 Stifel Nicolaus Healthcare Conference," Reuters, 1 page http://in.reuters.com/article/2013/09/05/idUSnGNX7PTmrq+1d8+GNW20130905 (2013).

Anonymous, "Stifel 2013 Healthcare Conference," pp. 1-35, http://www.novavax.com/download/file/2013_09_12%20Novavax_Stifel_presentation.pdf (2013).

Barr et al., "ISCOMs and other saponin based adjuvants," Advanced Drug Delivery Reviews, (1998), 32: 247-271.

Behboudi et al., "Quillaja Saponin Formulations that Stimulate Proinflammatory Cytokines Elicit a Potent Acquired Cell-Mediated Immunity," Scand. J. Immunol. 50:371-377 (1999).

(56) References Cited

OTHER PUBLICATIONS

Bengtsson et al., Matrix-M adjuvant increases immunogenicity of seasonal influenza vaccine for the elderly, manuscript in preparation, pp. 1-27 (2014).
Boulter, et al., Evaluation of recombinant sporozoite antigen SPAG-1 as a vaccine candidate against Theileria annulata by the use of different delivery systems, Tropical Medicine and International Health, vol. 4, pp. A71-A77 (1999), Blackwell Science, Ltd.
Brandenburg et al., Respiratory Syncytial Virus Specific Serum Antibodies in Infants Under Six Months of Age: Limited Serological Response Upon Infection, J. Med. Virol. 52:97-104 (1997).
Chan et al., "Functional Characterization of Heptad Repeat 1 and 2 Mutants of theSpike Protein of Severe Acute Respiratory Syndrome Coronavirus," Journal of Virology 3225-3237 (2006).
Chatterjee et al., "The 2019 novel coronavirus disease (COVID-19) pandemic: A review of the current evidence," Indian J Med Res 151(2-3):147-159 (Year: 2020).
Chen et al., "RNA based mNGS approach identifies a novel human coronavirus from two individual pneumonia cases in 2019 Wuhan outbreak," Emerging Microbes & Infections 9(1):313-319 (2019).
Chen, Y. et al., "Emerging coronaviruses: Genome structure, replication, and pathogenesis"; Journal of Medical Virology; (Jan. 22, 2020); vol. 92; issue 4, 7 pages.
Cheng et al., "Use of convalescent plasma therapy in SARS patients in Hong Kong," Eur. J. Clin. Microbiol. Infect. Dis. 24(1):44-46 (2005).
Citovsky et al., "Fusion of Sendai Virions or Reconstituted Sendai Virus Envelopes with Liposomes or Erythrocyte Membranes Lacking Virus Receptors," The Journal of Biological Chemistry 260(22)12072-12077 (1985).
Coleman et al., "Purified coronavirus spike protein nanoparticles induce coronavirus neutralizing antibodies in mice," Vaccine 32(26):3169-3174 (2014).
"Committee for Veterinary Medicinal Products, Quillaia Saponins, Summary Report", The European Agency for the rgJ Evaluation of Medicinal Products, EMEA/MRL/055/95-FINAL, Feb. 1996, pp. 1-2.
Copland et al., "Hydration of lipid films with an aqueous solution of Quil A: a simple method for the preparation of immune-stimulating complexes," International Journal of Pharmaceutics 196:135-139 (2000).
Coulter, et al., Studies on experimental adjuvanted influenza vaccines: comparison of immune stimulating complexes(Iscoms) and oil-in-water vaccines; Vaccine, vol. 16, No. 11/12, pp. 1243-1253 (1998), Elsevier Science Ltd., Great Britain.
Cox, et al., Development of an Influenza-ISCOM Vaccine, in Vaccine Design (eds. G. Gregoriadis et al.), Springer Science+Business Media, New York (1997), pp. 33-49.
Cox, et al., Evaluation of a virosomal H5N1 vaccine formulated with Maxtrix M adjuvant in phase I clinical trial, Elsevier Ltd, Vaccine, 29, pp. 8049-8059, Aug. 22, 2011.
Cox, et al., Prospects for the Development of New Vaccine Adjuvants, BioDrugs, vol. 12(6), pp. 439-453 (1999), Ad is International Limited.
Creemers et al., "Endoproteolytic Cleavage of Its Propeptide Is a Prerequisite for Efficient Transport of Furin Out of the Endoplasmic Reticulum," J. Biol. Chem. 270(6):2695-2702 (1995).
Crowe, Jr. "Influence of Maternal Antibodies on Neonatal Immunization against Respiratory Viruses," Clin. Infect. Dis. 33:1720-1727 (2001).
Database UniProt [Online], "SubName: Full=S Protein {ECO:0000313|EMBL:AGN70973.1}," EBI accesion No. UNIPROT:R9UQ53, Database accession No. R9UQ53 (2013).
Delmas and Laude, "Assembly of Coronavirus Spike Protein into Trimers and Its Role in Epitope Expression," Journal of Virology 64(11):5367-5375 (1990).
Demana et al., "A comparison of pseudo-ternary diagrams of aqueous mixtures of Quil A, cholesterol and phospholipid prepared by lipid-film hydration and dialysis," Journal of Pharmacy and Pharmacology 56:573-580 (2004).
Demana et al., "Pseudo-ternary phase diagrams of aqueous mixtures of Quil A, cholesterol and phospholipid prepared by the lipid-film hydration method," International Journal of Pharmaceutics 270:229-239 (2004).
Demirjian and Levy, "Safety and Efficacy of Neonatal Vaccination," Eur. J. Immunol. 39(1):36-46 (2009).
Drane et al., "Iscomatrix adjuvant for prophylactic and therapeutic vaccines," Expert Rev. Vaccines 6:761-772 (2007).
Du et al., "The spike protein of SRS-CpV—a target for vaccine and therapeutic development," Nat. Rev. Microbiol. 7(3):226-236 (2009).
Du, L., et al., "Identification of a Receptor-Binding Domain in the S Protein of the Novel Human Coronavirus Middle East Respiratory Syndrome Coronavirus as an Essential Target for Vaccine Development," J. Virol. 87(17):9939-9942 (2013).
Duan, et al., An overview of the novel coronavirus MERS-CoV, Chin J Viral Dis, 3(4):245-249 (2013).
Eckert et al., "Mechanisms of Viral Membrane Fusion and Its Inhibition," Annual Review of Biochemistry 70:770-810 (2001).
Ekstrom et al., "Iscom and iscom-matrix enhance by intranasal route the IgA responses to OVA and rCTB in local and remote mucosal secretions," Vaccine 17:2690-2701 (1999).
Ennis et al., "Augmentation of Human Influenza A Virus-Specific Cytotoxic T Lymphocyte Memory by Influenza Vaccine and Adjuvanted Carriers (ISCOMS)," Virology 25:256-261 (1999).
Eyles et al., "Immunodominant Francisella tularensis antigens identified using proteome microarray," Proteomics 7:2172-2183 (2007).
Follis et al.,"Furin cleavage of the SARS coronavirus spike glycoprotein enhances cell-cell fusion but does not affect virion entry," Virology 350(2):358-369 (2006).
Fossum et al., Early inflammatory response to the saponin adjuvant Matrix-M in the pig, Veterinary Immunology and Immunopathology, http://dx.doi.org/10.1 016/j.vetimm.2013.07.007 (2013), pp. 1-9, Elsevier B.V.
Genbank Accession No. AAC55970.1, "fusion glycoprotein precursor [Human respiratory syncytial virus]" (1996), 1 page.
Genocea Biosciences, Genocea Reports Positive Initial Phase 1/2A Results for GEN-003, It's Pioneering Therapeutic Vaccine Candidate for the Treatment of Herpes Simplex Virus-2 (HSV-2), at ICAAC 2013, press release, Cambridge MA, Sep. 12, 2013, pp. 1-3.
Giannos et al., Formulation Stabilization and Disaggregatoin of Bevacizumab, Ranibizumab and Aflibercept in Dilute Solutions, Pharm Res 35:78 (2018), 15 pages.
Gillim-Ross et al., "Emerging Respiratory Viruses: Challenges and Vaccine Strategies," Clin. Microbiol. Rev. 19(4):614-636 (2006).
Glenn et al., "Safety and immunogenicity of a Sf9 insect cell-derived respiratory syncytial virus fusion protein nanoparticle vaccine," Vaccine. Jan. 7, 2013;31(3):524-532.
Glenn, "Recombinant, Insect Cell-Derived RSV Nanoparticle Vaccine," Novavax.com, 34 pages (Jul. 4, 2012) https://www.novavax.com/download/file/RSV nanoparticleVaccine-MVADsJuly4(2).pdf.
Gonzalez-Reyes et al., "Cleavage of the human respiratory syncytial virus fusion protein at two distinct sites is required for activation of membrane fusion," Proc. Natl. Acad. Sci. USA 98(17):9859-9864 (2001).
Gretebeck et al., "Animal models for SARS and MERS coronaviruses," Virology, 13:123-129 (Year: 2015).
Gruenke et al., "New Insights into the Spring-Loaded Conformational Change of Influenza Virus Hemagglutinin," Journal of Virology, May 2002, 76:(9) 4456-4466 (2002).
Halsey and Galazka, "The efficacy of DPT and oral poliomyelitis immunization schedules initiated from birth to 12 weeks of age," Bull. World Health Org. 63(6):1151-1169 (1985).
Higgins et al., "Advances in RSV vaccine research and development—A global agenda," Vaccine 34:2870-2875 (2016).
Hilgenfeld et al., "From SARS to MERS: 10 years of research on highly pathogenic human coronaviruses," Antiviral Res. 100(1):286-295 (2013).
Hoffman, M. et al., "Priming Time: How Cellular Proteases Arm Coronavirus Spike Proteins"; Coronavirus Spike Protein: Springer International Publishing AG; (2018); pp. 71-98; DOI: 10.1007/978-3-319-75474-1_4.

(56) References Cited

OTHER PUBLICATIONS

Iyer et al., Purified, Proteolytically Mature HIV Type 1 SOSIP gp140 Envelope Trimers, Aids Research and Human Retroviruses 23(6):817-828 (2007).
Jackson et al.,"An mRNA Vaccine against SARS-CoV-2 Preliminary Report," The New England Journal of Medicine, pp. 1-12 (2020).
Jiang, et al., "A predicted receptor-binding and critical neutralizing domain in S protein of the novel human coronavirus HCoV-EMC", Journal of Infection (66):464-466 (2013).
Johansson et al., "Iscoms with different quillaja saponin components differ in their immunomodulating activities," Vaccine 17:2894-2900 (1999).
Kam et al.,"Antibodies against trimeric S glycoprotein protect hamsters against SARS-CoV challenge despite their capacity to mediate FcgammaRII-dependent entry into B cells in vitro," Vaccine 25(4):729-740 (2007).
Kanekiyo et al., "Self-assembling influenza nanoparticle vaccines elicit broadly neutralizing HINI antibodies," Nature 2013, vol. 499 p. 102-108.
Karin Lovgren Bengtsson, Bror Morein & Albert DME Osterhaus (2011) ISCOM technology-based Matrix M adjuvant: success in future vaccines relies on formulation, Expert Review of Vaccines, 10:4, 401-403, DOI: 10.1586/erv.11.25.
Kensil, Saponins as Vaccine Adjuvants, Critical Reviews in Therapeutic Drug Carrier Systems, vol. 13(1&2), pp. 1-55 (1996), Begell House, Inc.
Kersten et al., On the structure of immune-stimulating saponin-lipid complexes (iscoms) Biochimica et Biophysica Acta, 1062:165-171 (1991).
Kim et al., "Respiratory Syncytial Virus Disease in Infants Despite Prioir Administration of Antigenic Inactivated Vaccine," Am. J. Epidemil. 89(4):422-434 (1969).
Kirchdoerfer et al., "Stabilized coronavirus spikes are resistant to conformational changes induced by receptor recognition or proteolysis," Scientific Reports, pp. 1-11 (2018).
Kleine-Weber et al., Functional analysis of potential cleavage sites in the MERS coronavirus spike protein, Scientific Reports vol. 8, No. 1, article 16597, pp. 1-11 (2018).
Korber et al.,"Tracking Changes in SARS-CoV-2 Spike: Evidence that D614G Increases Infectivity of the COVID-19 Virus," Cell 182:1-16 (2020).
Kuroiwa, Y., et al., "Antigen-specific human polyclonal antibodies from hyperimmunized cattle," Nat. Biotechnol. 27(2):173-181 (2009).
Lavelle et al., "Cholera Toxin Promotes the Induction of Regulatory T Cells Specific for Bystander Antigens by Modulating Dendritic Cell Activation," Journal of Immunology 171:2384-2392 (2003).
Lee et al., "Recent Advances of Vaccine Adjuvants for Infectious Diseases ," Immune Network, 51-57 (2015).
Li et al., "Immunogenicity and Protection Efficacy of Monomeric and Trimeric Recombinant SARS Coronavirus Spike Protein Subunit Vaccine Candidates," Viral Immunology 26(2):126-132 (2013).
Lichtenberg et al., "The Mechanism of Detergent Solubilization of Lipid Bilayers," Biophysical Journal, vol. 105:289-299 (2013).
Lieberman et al., "Preparation and immunogenic properties of a recombinant West Nile subunit vaccine," Vaccine 25:414-423 (2007).
Liu et al., "Chimeric severe acute respiratory syndrome coronavirus (SARS-CoV) S glycoprotein and influenza matrix 1 efficiently form virus-like particles (VLPs) that protect mice against challenge with SARS-CoV," Vaccine 29(38):6606-6613 (2011).
Lovgren et al., The Requirement of Lipids for the Formation of Immunostimulating Complexes (Iscoms), Biotechnol. Appl. Biochem. 10:161-172 (1988).
Lovgren-Bengtsson, 6 Preparation and Use of Adjuvants; Methods in Microbiology, vol. 25, pp. 471-502 (1998), Academic Press Ltd.
Lovgren-Bengtsson et al., "4.5 Preparation and Use of Adjuvants," Methods in Microbiology 32:551-588 (2002).
Lu et al., "Immune responses against severe acute respiratory syndrome coronavirus induced by virus-like particles in mice," Immunol. 122:496-502 (2007).
Lucy et al., "Structure and Assembly of Macromolecular Lipid Complexes Composed of Globular Micelles," Journal of Molecular Biology, (1964), 8: 727-748.
Magnusson et al., Immune enhancing properties of the novel Matrix-M adjuvant leads to potentiated immune responses to an influenza vaccine in mice, Vaccine, http://dx.doi.org/10.1 016/j.vaccine.2013.01.039 (2013), pp. 1-9, Elsevier Ltd.
Magnusson et al., Matrix-M adjuvanted envelope protein vaccine protects against lethal lineage 1 and 2 West Nile virus infection in mice, Vaccine vol. 32, pp. 800-808 (2014), Elsevier Ltd.
Makwana et al., "Prefilled Syringes: An Innovation in Parenteral Packaging," International Journal of Pharmaceutical Investigation 1(4):200-206 (2011).
Matsushita et al., "Triple immunoglobulin gene knockout transchromosomic cattle: bovine lambda cluster deletion and its effect on fully human polyclonal antibody production," PLOS One 9(3):1-14 (2014).
McKenzie et al., ISCOMATRIX vaccines: Safety in human clinical studies, Human Vaccines, vol. 6, No. 3, pp. 237-246 (2010), Landes BioScience.
Morein et al., "Current status and potential application of ISCOMs in veterinary medicine," Advanced Drug Delivery Reviews 56:1367-1382 (2004).
Murphy et al., "An update on approaches to the development of respiratory syncytial virus (RSV) and parainfluenza virus type 3 (PIV3) vaccines," Virus Res. 32:13-26 (1994).
NCT01669512, Adjuvanting Viral Vectored Malaria Vaccines with Matrix M, dated Mar. 9, 2014, pp. 14.
NCT04368988, Evaluation of the Safety and Immunogenicity of a SARS-CoV-2 rS Nanoparticle Vaccine With/Without Matrix-M Adjuvant, dated Apr. 30, 2020, 21 pages.
NCT04533399, A Study Looking at the Effectiveness and Safety of a COVID-19 Vaccine in South African Adults, dated Aug. 31, 2020, 18 pages.
NCT04583995, A Study Looking at the Effectiveness, Immune Response, and Safety of a COVID-19 Vaccine in Adults in the United Kingdom, dated Oct. 12, 2020, 11 pages.
NCT04611802, A Study to Evaluate the Efficacy, Immune Response, and Safety of a COVID-19 Vaccine in Adults â‰¥ 18 Years With a Pediatric Expansion in Adolescents (12 to 18 Years) at Risk for SARS-CoV-2, dated Nov. 2, 2020,18 pages.
NCT04834869, COVID-19 Vaccines Safety Tracking (CoVaST), dated Apr. 8, 2021, 11 pages.
NCT04889209, Delayed Heterologous SARS-CoV-2 Vaccine Dosing (Boost) After Receipt of EUA Vaccines, dated May 17, 2021, 16 pages.
NCT04961541, Evaluation of the Safety and Immunogenicity of Influenza and COVID-19 Combination Vaccine, dated Jul. 14, 2021, 14 pages.
NCT05029856, Evaluation of the Safety and Immunogenicity of SII Vaccine Constructs Based on the SARS-COV-2 (COVID-19) Variant in Adults, dated Sep. 1, 2021, 13 pages.
NCT05112848, A Study to Evaluate Safety and Immunogenicity of a COVID-19 Vaccine in People Living With HIV at Risk for SARS-COV-2 (COVID-19), dated Nov. 9, 2021, 16 pages.
NCT05236491, COvid-19 Vaccine Booster in Immunocompromised Rheumatic Diseases, dated Feb. 11, 2022, 9 pages.
NCT05249816, Phase 3 Study to Evaluate a Single Booster of the NVX-CoV2373 COVID19 Vaccine in Adults, dated Feb. 22, 2022, 11 pages.
NCT05372588, Phase 3 Booster Study for the SARS-CoV-2 rS Vaccines, dated May 12, 2022, 12 pages.
Nord, "Novel acetylated triterpenoid saponins in a chromatographic fraction from Quilaja saponinaria Molina," Carb. Res. 329:817-829 (2000).
"Novavax NanoFlu Achieves All Primary Endpoints In Phase 3 Clinical Trial," Press Release dated Mar. 24, 2020, 3 pages.
NTC04961541, "Evaluation of the Safety and Immunogenicity of Influenza and COVID-19 Combination Vaccine," dated Jul. 14, 2021, 14 pages.
Nussbaum et al., "Fusion of influenza Virus particles with liposomes: requirement for cholesterol and virus receptors to allow fusion with

(56) References Cited

OTHER PUBLICATIONS and lysis of neutral but not of negatively charged liposomes",. Journal of General Virology, 2831-2837 (1992).
Ozel et al., "Quaternary Structure of the Immunostimulating Complex (Iscom)," Journal of Ultrastructure and Molecular Structure Research 102:240-248 (1989).
Pallesen et al., "Immunogenicity and structures of a rationally designed prefusion MERS-CoV spike antigen," PNAS E7348-E7357 (2017).
Parrington et al., "Baculovirus expression of the respiratory syncytial virus fusion protein using Trichoplusia ni insect cells," Virus Genes 14:63-72 (1997).
Parrish, "Novavax creates MERS-CoV vaccine candidate," http://vaccinenewsdaily.com/vaccine_development/325407-novavax-creates-mers-cov-vaccine-candidate/ (2013).
Pedersen et al., Matrix-M adjuvanted virosomal H5N1 vaccine confers protection against lethal viral challenge in a murine model, Influenza and Other Respiratory Viruses. DOI: 1 0.1111/j.1750-2659.2011.00256.x (2011 ), pp. 1-12, Blackwell Publishing Ltd.
Pedersen, et al.; T-Helper 1 Cells Elicited by H5N1 Vaccination Predict Seroprotection, Journal of Infectious Disease, 206, pp. 158-166, Jul. 15, 2016.
Poulsen et al., "Limits for Antibody Affinity Maturation and Repetoire Diversification in Hyper vaccinated Humans," J. Immunol. 187(8):4429-4235 (2011).
Rama et al., "An insect cell derived respiratory syncytial virus (RSV) F nanoparticle vaccine induces antigenic site II antibodies and protects against RSV challenge in cotton rats by active and passive immunization", Vaccine, Elsevier, Amsterdam, NL, 32(48)6485-6492 (2014).
Rey, F. A. et al., "Common Features of Enveloped Viruses and Implications for Immunogen Design for Next-Generation Vaccines"; Cell; (Mar. 8, 2018); vol. 172; issue 6.
Rimmelzwaan. et al., A randomized, double blind study in young healthy adults comparing cell mediated and 1 humoral immune responses induced by influenza ISCOM vaccines and conventional vaccines; Vaccine, 2001, vol. 19, pp. 1180-1187, Elsevier Science Limited.
Ronnberg et al., "Adjuvant activity of non-toxic Quillaja saponaria Molina components for use in ISCOM matrix," Vaccine, vol. 13, No. 14, pp. 1375-1382 (1995).
Safety and Immunogenicity Study of Therapeutic HSV-2 Vaccine, Identifier NCT01667341, ClinicalTrials.gov, U.S. National Institutes of Health; available at http://clinicaltrials.gov/ct2/show/NCT01667341 ?term=matrix+m&rank=3, Mar. 9, 2014, pp. 1-4.
Sales and Wang, "Respiratory syncytial virus vaccine: Is it coming?" Paediatr. Child Health 8(10):605-608 (2003).
Sekimukai et al., "Gold nanoparticle-adjuvanted S protein induces a strong antigen-specific IgG response against severe acute respiratory syndrome-related coronavirus infection, but fails to induce protective antibodies and limit eosinophilic infiltration in lungs," Microbiology and Immunology,64:33-51 (Year: 2020).
Shen, X. et al. Neutralization of SARS-CoV-2 Variants B.1.429 and B.1.351, N Engl J Med. (Apr. 7, 2021).
Shi et al., "Stabilization of Human Papillomavirus Virus-Like Particles by Non-Ionic Surfactants," Journal of Pharmaceutical Sciences, 2005, p. 1538-1551.
Shimizu, "Chapter 32. Routes of Administration," in The Laboratory Mouse, Hans Hedrich and Gillian Bullock, Eds., Elsevier Academic Press, 15 pages (2004).
Shinde et al., "Improved Titers Against Influenza Drift Variants with a Nanoparticle Vaccine," N Engl Med 378:24 (2018), 3 pages.
Shinde et al, Induction of Broadly Cross-Reactive Immune Responses Against A(H3N2) Viruses: Results of a Phase 2 Trial of a Novel Recombinant Hemagglutinin Saponin-Adjjvanted nanoparticle Influenza Vaccine ("NanoFlu"), 30 pages (2018).
Siegrist, "Mechanisms by which maternal antibodies influence infant vaccine responses: review of hypotheses and definition of main determinants," Vaccine 21:3406-3412 (2003).
Sjolander, et al., ISCOMs: an adjuvant with multiple functions, Journal of Leukocyte Biology, vol. 64, pp. 713-723 (1998).
Sjolander, et al., Uptake and adjuvant activity of orally delivered saponin and ISCOM vaccines, Advanced Drug Delivery Reviews, vol. 34, pp. 321-338 (1998), Elsevier Science B.V.
Skoberne et al., An adjuvanted herpes simplex virus 2 subunit vaccine elicits a T cell response in mice and is an effective therapeutic vaccine in Guinea pigs, J. Virol. 87:3930-3942 (2013).
Smith et al., "Novel hemagglutinin nanoparticle influenza vaccine with Matrix-M adjuvant induces hemagglutination inhibition, neutralizing, and protective responses in ferrets against homologous and drifted A(H3N2) subtypes," Vaccine 35:5366-5372 (2017).
Song, F., et al., "Middle East Respiratory Syndrome Coronavirus Spike Protein Delivered by Modified Vaccinia Virus Ankara Efficiently Induces Virus-Neutralizing Antibodies," J. Virol. 87(21):11950-11954 (2013).
Sun et al., "Advances in saponin-based adjuvants," Vaccine 27:1787-1796 (2009).
Sun et al., "ISCOMs and ISOMATRIX," Vaccine 27:4388-4401 (2009).
Tekewe et al., A rapid and simple screening method to identify conditions for enhanced stability of modular vaccine candidates, Biochemical Engineering Journal 100:50-58 (2015).
Third Party Observation: Additional Comments in Respect of WO2021154812, Document #11 issued for International Application No. PCT/US2021/015220 on May 27, 2022, 2 pages.
Third Party Observation issued for International Application No. PCT/US2021/015220 on May 27, 2022, 11 pages.
Tian et al., "SARS-CoV-2 spike glycoprotein vaccine candidate NVX-CoV2373 elicits immunogenicity in baboons and protection in mice," Jun. 29, 2020, 50 pages.
Tian et al., "SARS-CoV-2 spike glycoprotein vaccine candidate NVX-CoV2373 elicits immunogenicity in baboons and protection in mice," Nature Communications vol. 12, No. 1, Article 372, pp. 1-14 (2021).
Vaarala et al., "Antigenic Differences between AS03 Adjuvanted Influenza A (H1N1) Pandemic Vaccines: Implications for Pandemrix Associated Narcolepsy Risk," PLOS One, 1-23 (2014).
Van Boheemen et al., "Genomic Characterization of a Newly Discovered Coronavirus Associated with Acute Respiratory Distress Syndrome in Humans," mBio 3(6):e00473-12, 9 pages (2012).
Van Doremalen N. et al. ChAdOx1 nCoV-19 vaccination prevents SARS-CoV-2 pneumonia in rhesus macaques. bioRxiv, 23 pages (2020).
Wald, "A Novel Therapeutic Vaccine (GEN003) for Genital Herpes Reduces HSV-2 Shedding: Initial Results of Clinical Trial GEN003-001," Presented at Interscience Conference on Antimicrobial Agents and Chemotherapy (ICAAC 2013), Denver, CO, Sep. 12, 2013, pp. 1-21.
Wald et al., Novel Therapeutic Vaccine for Genital Herpes Reduces Genital HSV-2 Shedding, in ICAAC 2013, Denver, CO, Sep. 2013, cover page and p. 279, Abstract 183(G).
Walls et al., "Functional Characterization of Heptad Repeat 1 and 2 Mutants of the Spike Protein of Severe Acute Respiratory Syndrome Coronavirus," Nature 531, 17 pages (2016).
Wang et al., "Subunit Vaccines Against Emerging Pathogenic Human Coronaviruses," Frontiers in Microbiology, 11:298, 19 pages (Year: 2020).
Wang, "Protein aggregation and its inhibition in biopharmaceutics," International Journal of Pharmaceutics 289 (2005) 1-30.
Weisshaar et al., "Blocking Respiratory Syncytial Virus Entry: A Story with Twists," DNA Cell Biol. 34:505-510 (2015).
Whitehead et al., "Recombinant Respiratory Syncytial Virus (RSV) Bearing a Set of Mutations from Cold-Passaged RSV is Attenuated in Chimpanzees," J. Virol. 72(5):4467-4471 (1998).
Wrapp et al.,"Cryo EM Structure of the 2019 nCoV spike in the Prefusion Conformation," bioRxiv, posted Feb. 15, 2020 online at https://doi.org/10.1101/2020.02.11.944462, 30 pages.
Wrapp et al.,Cryo EM Structure of the 2019 nCoV spike in the Prefusion Conformation Science 10.1126/science.abb2507 (2020), 9 pages.

(56) References Cited

OTHER PUBLICATIONS

Wu et al., "Active 1918 pandemic flu viral neuraminidase has distinct N-glycan profile and is resistant to trypsin digestion," Biochemical and Biophysical Research, 2009, vol. 379. p. 749-753.
Yeh, "Experience of using convalescent plasma for severe acute respiratory syndrome among healthcare workers in a Taiwan hospital," J. Antimicrob. Chemother. 56(5):919-922 (2005).
European Patent Office, "Extended European Search Report", App. No. 22799423.3, Feb. 25, 2025, 9 pgs.
Taiwan Patent Office, "Notice of First Office Action", App. No. TW 111116974, Jan. 23, 2026, 15 pgs. (with English translation).
Russian Patent Office, "Office Action" App. No. 2023131792, Oct. 23, 2025, 22 pgs. (with English 1 translation).
C. Nozaki, "Current Status and Challenges of Vaccines", Faculty of Health Science, Kumamoto Health Science University, 2016, vol. 76, No. 1, pp. 4-10 (18 pp. with English translation).
Japan Patent Office, "Office Action", App. No. 2023-568063, Apr. 13, 2026, 7 pgs. (with English translation).

* cited by examiner

Fig. 1

MFVFLVLLPLVSSQCVNLTTRTQLPPAYTNSFTRGVYYPDKVFRSSVLHSTQDLFLPFFSN
VTWFHAIHVSGTNGTKRFDNPVLPFNDGVYFASTEKSNIIRGWIFGTTLDSKTQSLLIVNN
ATNVVIKVCEFQFCNDPFLGVYYHKNNKSWMESEFRVYSSANNCTFEYVSQPFLMDLEG
KQGNFKNLREFVFKNIDGYFKIYSKHTPINLVRDLPQGFSALEPLVDLPIGINITRFQTLLAL
HRSYLTPGDSSSGWTAGAAAYYVGYLQPRTFLLKYNENGTITDAVDCALDPLSETKCTLK
SFTVEKGIYQTSNFRVQPTESIVRFPNITNLCPFGEVFNATRFASVYAWNRKRISNCVADYS
VLYNSASFSTFKCYGVSPTKLNDLCFTNVYADSFVIRGDEVRQIAPGQTGKIADYNYKLP
DDFTGCVIAWNSNNLDSKVGGNYNYLYRLFRKSNLKPFERDISTEIYQAGSTPCNGVEGF
NCYFPLQSYGFQPTNGVGYQPYRVVVLSFELLHAPATVCGPKKSTNLVKNKCVNFNFNG
LTGTGVLTESNKKFLPFQQFGRDIADTTDAVRDPQTLEILDITPCSFGGVSVITPGTNTSNQ
VAVLYQDVNCTEVPVAIHADQLTPTWRVYSTGSNVFQTRAGCLIGAEHVNNSYECDIPIG
AGICASYQTQTNSPRRARSVASQSIIAYTMSLGAENSVAYSNNSIAIPTNFTISVTTEILPVS
MTKTSVDCTMYICGDSTECSNLLLQYGSFCTQLNRALTGIAVEQDKNTQEVFAQVKQIYK
TPPIKDFGGFNFSQILPDPSKPSKRSFIEDLLFNKVTLADAGFIKQYGDCLGDIAARDLICA
QKFNGLTVLPPLLTDEMIAQYTSALLAGTITSGWTFGAGAALQIPFAMQMAYRFNGIGVT
QNVLYENQKLIANQFNSAIGKIQDSLSSTASALGKLQDVVNQNAQALNTLVKQLSSNFGA
ISSVLNDILSRLDKVEAEVQIDRLITGRLQSLQTYVTQQLIRAAEIRASANLAATKMSECV
LGQSKRVDFCGKGYHLMSFPQSAPHGVVFLHVTYVPAQEKNFTTAPAICHDGKAHFPRE
GVFVSNGTHWFVTQRNFYEPQIITTDNTFVSGNCDVVIGIVNNTVYDPLQPELDSFKEEL
DKYFKNHTSPDVDLGDISGINASVVNIQKEIDRLNEVAKNLNESLIDLQELGKYEQYIKWP
WYIWLGFIAGLIAIVMVTIMLCCMTSCCSCLKGCCSCGSCCKFDEDDSEPVLKGVKLHYT

SEQ ID NO: 1

BV2373 (SEQ ID NO: 86)

CoV-2019/QQAQ/K986P/V987P

Inactive furin cleavage site

Signal peptide

MFVFLVLLPLVSSQCVNLTTRTQLPPAYTNSFTRGVYYPDKVFRSSVLHSTQDLFLPFFSNVTWFHAIHVSGT
NGTKRFDNPVLPFNDGVYFASTEKSNIIRGWIFGTTLDSKTQSLLIVNNATNVVIKVCEFQFCNDPFLGVYYH
KNNKSWMESEFRVYSSANNCTFEYVSQPFLMDLEGKQGNFKNLREFVFKNIDGYFKIYSKHTPINLVRDLPQG
FSALEPLVDLPIGINITRFQTLLALHRSYLTPGDSSSGWTAGAAAYYVGYLQPRTFLLKYNENGTITDAVDCA
LDPLSETKCTLKSFTVEKGIYQTSNFRVQPTESIVRFPNITNLCPFGEVFNATRFASVYAWNRKRISNCVADY
SVLYNSASFSTFKCYGVSPTKLNDLCFTNVYADSFVIRGDEVRQIAPGQTGKIADYNYKLPDDFTGCVIAWNS
NNLDSKVGGNYNYLYRLFRKSNLKPFERDISTEIYQAGSTPCNGVEGFNCYFPLQSYGFQPTNGVGYQPYRVV
VLSFELLHAPATVCGPKKSTNLVKNKCVNFNFNGLTGTGVLTESNKKFLPFQQFGRDIADTTDAVRDPQTLEI
LDITPCSFGGVSVITPGTNTSNQVAVLYQDVNCTEVPVAIHADQLTPTWRVYSTGSNVFQTRAGCLIGAEHVN
NSYECDIPIGAGICASYQTQTNSPQQAQSVASQSIIAYTMSLGAENSVAYSNNSIAIPTNFTISVTTEILPVS
MTKTSVDCTMYICGDSTECSNLLLQYGSFCTQLNRALTGIAVEQDKNTQEVFAQVKQIYKTPPIKDFGGFNFS
QILPDPSKPSKRSFIEDLLFNKVTLADAGFIKQYGDCLGDIAARDLICAQKFNGLTVLPPLLTDEMIAQYTSA
LLAGTITSGWTFGAGAALQIPFAMQMAYRFNGIGVTQNVLYENQKLIANQFNSAIGKIQDSLSSTASALGKLQ
DVVNQNAQALNTLVKQLSSNFGAISSVLNDILSRLDPPEAEVQIDRLITGRLQSLQTYVTQQLIRAAEIRASA
NLAATKMSECVLGQSKRVDFCGKGYHLMSFPQSAPHGVVFLHVTYVPAQEKNFTTAPAICHDGKAHFPREGVF
VSNGTHWFVTQRNFYEPQIITTDNTFVSGNCDVVIGIVNNTVYDPLQPELDSFKEELDKYFKNHTSPDVDLGD
ISGINASVVNIQKEIDRLNEVAKNLNESLIDLQELGKYEQYIKWPWYIWLGFIAGLIAIVMVTIMLCCMTSCC
SCLKGCCSCGSCCKFDEDDSEPVLKGVKLHYT

HA nanoparticles (detergent core)

saponin adjuvant

HA nanoparticles HaSMaNs (Hemagglutinin Saponin Matrix Nanoparticles)

A/Kansas/14/2017 (H3N2)
5μg CoV2373
15μg/Strain qNIV + 5μg CoV2373
60μg/Strain qNIV + 5μg CoV2373
15μg/Strain qNIV
60μg/Strain qNIV
HAI Titer
4096
2048
1024
512
256
128
64
32
16
21
35
Days B/Maryland/15/2016

CORONAVIRUS AND INFLUENZA COMPOSITIONS AND METHODS FOR USING THEM

CROSS-REFERENCE TO RELATED APPLICATIONS

This application claims priority to U.S. Patent Application No. 63/184,727, filed on May 5, 2021; U.S. Application No. 63/193,356, filed on May 26, 2021; U.S. Application No. 63/255,685, filed on Oct. 14, 2021; U.S. Application No. 63/332,537, filed on Apr. 19, 2022. Each of the aforementioned patent documents is incorporated by reference herein in its entirety.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: NOVV_093_01WO_SeqList_ST25.txt, date recorded: Apr. 22, 2022; file size: 976 kilobytes).

FIELD OF THE DISCLOSURE

The present disclosure relates to compositions and methods for inducing immune responses against both influenza and coronaviruses.

BACKGROUND OF THE INVENTION

Influenza and coronavirus disease 2019 (COVID-19) are life-threatening illnesses caused by the viruses influenza virus and sudden acute respiratory coronavirus 2 (SARS-CoV-2), respectively. The case fatality rate of patients diagnosed with influenza is approximately 0.1%, and the case fatality rate of patients diagnosed with COVID-19 ranges from 0.2% to 7.7%.

The development of vaccines that prevent or reduce the severity of these life-threatening infectious diseases is desirable. However, human vaccine development remains challenging because of the highly sophisticated evasion mechanisms of pathogens and difficulties stabilizing vaccines. Optimally, a vaccine must both induce antibodies that block or neutralize infectious agents and remain stable in various environments, including environments that do not enable refrigeration. Combination of two antigens from two pathogens in a single vaccine composition is particularly challenging because the antigens may interact with each other, preventing a sufficient immune response to either pathogen.

SUMMARY OF THE INVENTION

The present disclosure provides compositions and methods for inducing immune responses against both influenza and coronaviruses.

Provided herein is an immunogenic composition comprising: (a) a coronavirus S (CoV S) glycoprotein in the form of a detergent-core nanoparticle, wherein the detergent is a non-ionic detergent; (b) at least three hemagglutinin (HA) glycoproteins, wherein each HA glycoprotein is from a different influenza strain; and (c) a pharmaceutically acceptable buffer. In embodiments, the at least three HA glycoproteins are in a form selected from the group consisting of: (a) detergent-core nanoparticles comprising hemagglutinin (HA); (b) HaSMaNs (Hemagglutinin Saponin Matrix Nanoparticles); (c) an inactivated whole influenza virus; (d) a hemagglutinin composition extracted from an influenza virus; optionally an influenza split-virion composition or a subunit influenza composition; and any combination thereof. In embodiments, at least one HA glycoprotein is in the form of a detergent-core nanoparticle comprising HA and at least one HA glycoprotein is in the form of a HaSMaN. In embodiments, the hemagglutinin glycoprotein of the detergent-core nanoparticle is from a Type B influenza strain. In embodiments, the hemagglutinin glycoprotein of the detergent-core nanoparticle is from a Type A influenza strain. In embodiments, the detergent-core nanoparticle is a trypsin-resistant nanoparticle. In embodiments, the HaSMaN is a trypsin-resistant nanoparticle. In embodiments, each HA glycoprotein is from a different influenza strain. In embodiments, the immunogenic composition comprises up to 4, up to 5, up to 6, up to 7, up to 8, up to 9, or up to 10 HA glycoproteins. In embodiments, each HA glycoprotein is in the form of a nanoparticle. In embodiments, each nanoparticle comprises a HA glycoprotein from a single influenza strain. In embodiments, each nanoparticle is a detergent-core nanoparticle or a HaSMaN. In embodiments, the immunogenic compositions comprise an adjuvant. In embodiments, the adjuvant is a saponin adjuvant. In embodiments, the saponin adjuvant comprises at least two iscom particles, wherein: the first iscom particle comprises fraction A of *Quillaja Saponaria Molina* and not fraction C of *Quillaja Saponaria Molina*; and the second iscom particle comprises fraction C of *Quillaja Saponaria Molina* and not fraction A of *Quillaja Saponaria Molina*. In embodiments, fraction A of *Quillaja Saponaria Molina* accounts for 50-96% by weight and fraction C of *Quillaja Saponaria Molina* accounts for the remainder, respectively, of the sum of the weights of fraction A of *Quillaja Saponaria Molina* and fraction C of *Quillaja Saponaria Molina* in the adjuvant. In embodiments, fraction A of *Quillaja Saponaria Molina* and fraction C of *Quillaja Saponaria Molina* account for about 85% by weight and about 15% by weight, respectively, of the sum of the weights of fraction A of *Quillaja Saponaria Molina* and fraction C of *Quillaja Saponaria Molina* in the adjuvant. In embodiments, the immunogenic composition comprises about 50 μg or about 75 μg saponin adjuvant. In embodiments, the detergent is PS80. In embodiments, the influenza strain is of a subtype selected from the group consisting of H1, H2, H3, H4, H5, H6, H7, H8, H9, H10, H11, H12, H13, H14, H15, H16, H17, and H18. In embodiments, the pharmaceutically acceptable buffer comprises (i) sodium phosphate at about 25 mM; (ii) sodium chloride at about 150 mM; (iii) arginine hydrochloride at about 100 mM; (iv) trehalose at about 5%; wherein the composition pH is at about 7.5. In embodiments, the CoV S glycoprotein comprises (i) an S1 subunit with an inactivated furin cleavage site, wherein the S1 subunit comprises an N-terminal domain (NTD), a receptor binding domain (RBD), subdomains 1 and 2 (SD1/2), wherein the inactivated furin cleavage site has an amino acid sequence of QQAQ (SEQ ID NO: 7); wherein the NTD optionally comprises one or more modifications selected from the group consisting of: (a) deletion of one or more amino acids selected from the group consisting of amino acid 56, 57, 131, 132, 144, 145, 228, 229, 230, 231, 234, 235, 236, 237, 238, 239, 240 and combinations thereof; (b) insertion of 1, 2, 3, or 4 amino acids after amino acid 132; and (c) mutation of one or more amino acids selected from the group consisting of amino acid 5, 6, 7, 13, 51, 53, 56, 57, 62, 63, 67, 82, 125, 129, 131, 132, 133, 139, 143, 144, 145, 177, 200, 201, 202, 209, 229, 233, 240, 245, and combinations thereof; wherein the RBD optionally comprises mutation of one or more amino acids selected from the group consisting of amino acid 333, 404, 419, 426, 439, 440, 464, 465, 471, 477, 481, 488, and combinations thereof; wherein the SD1/2 domain optionally comprises mutation of one or more amino acids selected from the group consisting of 557, 600, 601, 642, 664, 668, and combinations thereof; and (ii) an S2 subunit, wherein amino acids 973 and 974 are proline, wherein the S2 subunit optionally comprises one or more modifications selected from the group consisting of: (a) deletion of one or more amino acids from 676-685, 676-702, 702-711, 775-793, 806-815 and combinations thereof; (b) mutation of one or more amino acids selected from the group consisting of 688, 703, 846, 875, 937, 969, 1014, 1058, 1105, and 1163 and combinations thereof; and (c) deletion of one or more amino acids from the TMCT; wherein the amino acids of the CoV S glycoprotein are numbered with respect to a polypeptide having the sequence of SEQ ID NO: 2. In embodiments, the CoV S glycoprotein comprises or consists of an amino acid sequence with at least 90%, at least 91%, at least 92%, at least 93%, at least 94%, at least 95%, at least 96%, at least 97%, at least 98%, at least 99%, or 100% identity to any one of SEQ ID NOS: 86-89, 105, 106, 112-115, and 164-168. In embodiments, the CoV S glycoprotein comprises a sequence that is at least 90%, at least 91%, at least 92%, at least 93%, at least 94%, at least 95%, at least 96%, at least 97%, at least 98%, at least 99%, or 100% identical to SEQ ID NO: 87. In embodiments, the immunogenic composition comprises from about 1 μg to about 50 μg of CoV S glycoprotein and from about 5 μg to about 60 μg of hemagglutinin per strain. In embodiments, the immunogenic composition comprises from about 20 μg to about 50 μg of CoV S glycoprotein and from about 24 μg to about 40 μg of hemagglutinin per strain. In embodiments, the immunogenic composition comprises about 3 μg, about 5 μg, about 25 μg, about 22.5 μg, about 7.5 μg, or about 2.5 μg of coronavirus S glycoprotein. In embodiments, the immunogenic composition comprises about 5 μg, about 10 μg, about 24 μg, about 25 μg, about 26 μg, about 27 μg, about 28 μg, about 29 μg, about 30 μg, about 31 μg, about 32 μg, about 33 μg, about 34 μg, about 35 μg, about 36 μg, about 37 μg, about 38 μg, about 39 μg, about 40 μg, or about 60 μg of hemagglutinin per strain.

In embodiments, provided herein is a method of stimulating an immune response against SARS-CoV-2, a heterogeneous SARS-CoV-2 strain, an influenza virus, or a combination thereof in a subject comprising administering any immunogenic composition described herein. In embodiments, the subject is administered a first dose at day 0 and a boost dose at day 56. In embodiments, the immunogenic composition is administered intramuscularly. In embodiments, a single dose of the immunogenic composition is administered. In embodiments, the heterogenous SARS-CoV-2 strain is selected from the group consisting of Ca1.20C SARS-CoV-2 strain, P.1 SARS-CoV-2 strain, B.1.351 SARS-CoV-2 strain, B.1.1.7 SARS-CoV-2 strain, SARS-CoV-2 B.1.617.2 strain, B.1.525 strain, B.1.526 strain, B.1.617.1 strain, C.37 strain, B.1.621 strain, or the SARS-CoV-2 omicron strain. In embodiments, the efficacy of the immunogenic composition for preventing coronavirus disease-19 (COVID-19) is at least 50%, at least about 55%, at least about 60%, at least about 65%, at least about 70%, at least about 75%, at least about 80%, at least about 85%, about least about 90%, at least about 91%, at least about 92%, at least about 93%, at least about 94%, at least about 95%, at least about 96%, at least about 97%, at least about 98%, or at least about 99%, or about 100% for up to about 2 months, up to about 2.5 months, up to about 3 months, up to about 3.5 months, up to about 4 months, up to about 4.5 months, up to about 5 months, up to about 5.5 months, up to about 6 months, up to about 6.5 months, up to about 7 months, up to about 7.5 months, up to about 8 months, up to about 8.5 months, up to about 9 months, up to about 9.5 months, up to about 10 months, up to about 10.5 months, up to about 11 months, up to about 11.5 months, or up to about 12 months after administration of the immunogenic composition. In embodiments, the efficacy of the immunogenic composition for preventing coronavirus disease-19 (COVID-19) is from about 50% to about 99%, from about 50% to about 95%, from about 50% to about 90%, from about 50% to about 85%, from about 50% to about 80%, from about 60% to about 99%, from about 60% to about 95%, from about 60% to about 90%, from about 60% to about 85%, from about 60% to about 80%, from about 40% to about 99%, from about 40% to about 95%, from about 40% to about 90%, from about 40% to about 85%, from about 40% to about 80%, from about 40% to about 75%, from about 40% to about 70%, from about 40% to about 65%, from about 40% to about 55%, or from about 40% to about 50% for up to about 2 months, up to about 2.5 months, up to about 3 months, up to about 3.5 months, up to about 4 months, up to about 4.5 months, up to about 5 months, up to about 5.5 months, up to about 6 months, up to about 6.5 months, up to about 7 months, up to about 7.5 months, up to about 8 months, up to about 8.5 months, up to about 9 months, up to about 9.5 months, up to about 10 months, up to about 10.5 months, up to about 11 months, up to about 11.5 months, or up to about 12 months after administration of the immunogenic composition. In embodiments, provided herein is a prefilled syringe comprising any immunogenic composition described herein.

BRIEF DESCRIPTION OF THE DRAWINGS

FIG. 1 shows a schematic of a wild-type amino acid sequence of the SARS-CoV-2 Spike (S) protein (SEQ ID NO: 1). The furin cleavage site RRAR (SEQ ID NO: 6) is highlighted in bold, and the signal peptide is underlined.

FIG. 5 shows a schematic of the coronavirus Spike (S) protein (SEQ ID NO: 86) (BV2373). The furin cleavage site QQAQ (SEQ ID NO: 7) is underlined once, and the K986P and V987P mutations are underlined twice.

(FIG. 8A) Groups of male and female ferrets (n=6/group) were immunized with a combination of 15 μg or 60 μg hemagglutinin (HA) per strain with 5 μg CoV2373 with 50 μg saponin adjuvant. Comparator groups were immunized with 15 μg or 60 μg HA per strain or with 5 μg CoV22373 with 50 μg saponin adjuvant. All groups were immunized with two doses spaced 21 days apart. Red triangles indicate serum collection days. (FIG. 8B) Human angiotensin converting enzyme-2 (hACE2) receptor blocking antibody titer. Hemagglutinin inhibiting antibodies (HAI) titers 21 days after 1-dose and 14 days after the booster immunization (study day 35). (FIG. 8C) A/Kansas/14/2017. (FIG. 8D) A/Brisbane/02/2018. (FIG. 8E) B/Phuket/3070/2013. (FIG. 8F) B/Maryland/15/2016. Bars indicate the geometric mean titer (GMT) and error bars indicate the 95% confidence interval.

(FIG. 9A) Groups of male and female hamsters (n=5-6 per group) were immunized with a combination of 2.5 or 10 μg hemagglutinin (HA)/strain with 1 or 5 μg CoV2373 with 15 μg saponin adjuvant. Comparator groups were immunized with 2.5 or 10 μg HA/strain or 1 or 5 μg CoV2373 with 15 μg saponin adjuvant. Animals were immunized by the intramuscular route (IM) with 2 doses spaced 14 days apart. The placebo group received formulation buffer. Sera were collected for analysis as indicated by the red triangles. Immunized and placebo animals were infected by the intranasal (IN) route with $2.0\times10^4$ pfu of SARS-CoV-2 at 21 days after the second immunization. Oral swabs were collected at 2, 4 and 7 days post infection (dpi, blue triangles). Branchoalveolar lavage and lung samples were collected 7 dpi (black triangle). (FIG. 9B, FIG. 9C) Anti-spike IgG titer 14 days after 1 dose and 14 days after the booster immunization (study day 28), respectively. (FIG. 9D, FIG. 9E) Human ACE-2 (hACE2) receptor blocking antibody titer 14 days after 1 dose and 14 days after the booster immunization, respectively. The bars indicate the group geometric mean titer (GMT) and the error bars indicate the 95% confidence interval (95% CI). Individual animal values are indicated by the colored symbols. The horizontal dashed black line indicates the limit of detection (LOD).

(FIG. 10A, FIG. 10B) A/Kansas/14/2017. (FIG. 10C, FIG. 10D) A/Brisbane/02/2018. (FIG. 10E, FIG. 10F) B/Phuket/3070/2013. (FIG. 10G, FIG. 10H) B/Maryland/15/2016. Bars indicate the geometric mean titer and error bars indicate the 95% confidence interval.

FIG. 12A, FIG. 12B, and FIG. 12C show antibodies against the SARS-CoV-2 US-WA RBD. FIG. 12D and FIG. 12E show antibodies against the SARS-CoV-2 B.1.351 South Africa RBD.

FIG. 13A and FIG. 13B show the change in body weight (percent change following SARS-CoV-2 challenge) for up to 7 days post infection (dpi). Data are the mean f SEM for the vaccinated, placebo, and sham groups. FIG. 13C and FIG. 13D show subgenomic (sg) RNA in buccal swabs were taken at 2, 4, and 7 days post infection (dpi). sgRNA was analyzed by qRT-PCR. FIG. 13E shows sgRNA virus load in branchoalveolar lavage fluids collected 7 days post infection (dpi). FIG. 13F shows sgRNA virus load in lung homogenates collected 7 dpi. In the box-and-whisker plots, the median is indicated by the horizontal line, the top and bottom of the box indicates the interquartile range, and the whiskers indicate minima and maxima for each experimental group (n=5-6/group). Individual animal values are indicated by colored symbols. The dashed line indicates the assay limit of detection (LOD). Student's t-test (paired, two tail) was used to determine significant differences in levels of viral sgRNA between placebo treated animals and immunized animals a 2, 4 and 7 dpi. Not significant (ns), *p≤0.001, p≤0.0001. FIG. 13**G shows the weight of lungs collected at 7 dpi from vaccinated, placebo treated, and untreated sham animals. The bars indicate the mean and the error bars indicate the ±standard deviation (SD). Individual animal values are indicated by the colored symbols. Student's t-test (paired, two tail) was used to determine significant differences in lung weigh between the indicated paired groups.

FIG. 14A is a sham control image that shows normal lung. FIG. 14B shows microscopic findings in the lungs of placebo treated animals showed the airways were consolidated by bronchiolo-alveolar hyperplasia (arrows) with mixed alveolar inflammation. Mononuclear inflammatory cells surround blood vessels (arrowhead) with edema expanding surrounding tissues (arrowhead). FIG. 14C and FIG. 14D show microscopic findings in the lungs of animals immunized with qNIV show histologic changes similar to the placebo group including extensive bronchiolo-alveolar hyperplasia (arrows) with mixed alveolar inflammation with perivascular inflammation and expanded vessel walls (arrowheads). FIG. 14E and FIG. 14F show images of lungs from animals immunized with monovalent CoV2373 show no significant microscopic findings. FIG. 14G, FIG. 14H, FIG. 14I, and FIG. 14J are images of lungs from animals immunized with qNIV/CoV2373 combination vaccine show no significant microscopic findings. Magnification 10×.

DETAILED DESCRIPTION OF THE INVENTION

Definitions

Figure 2:
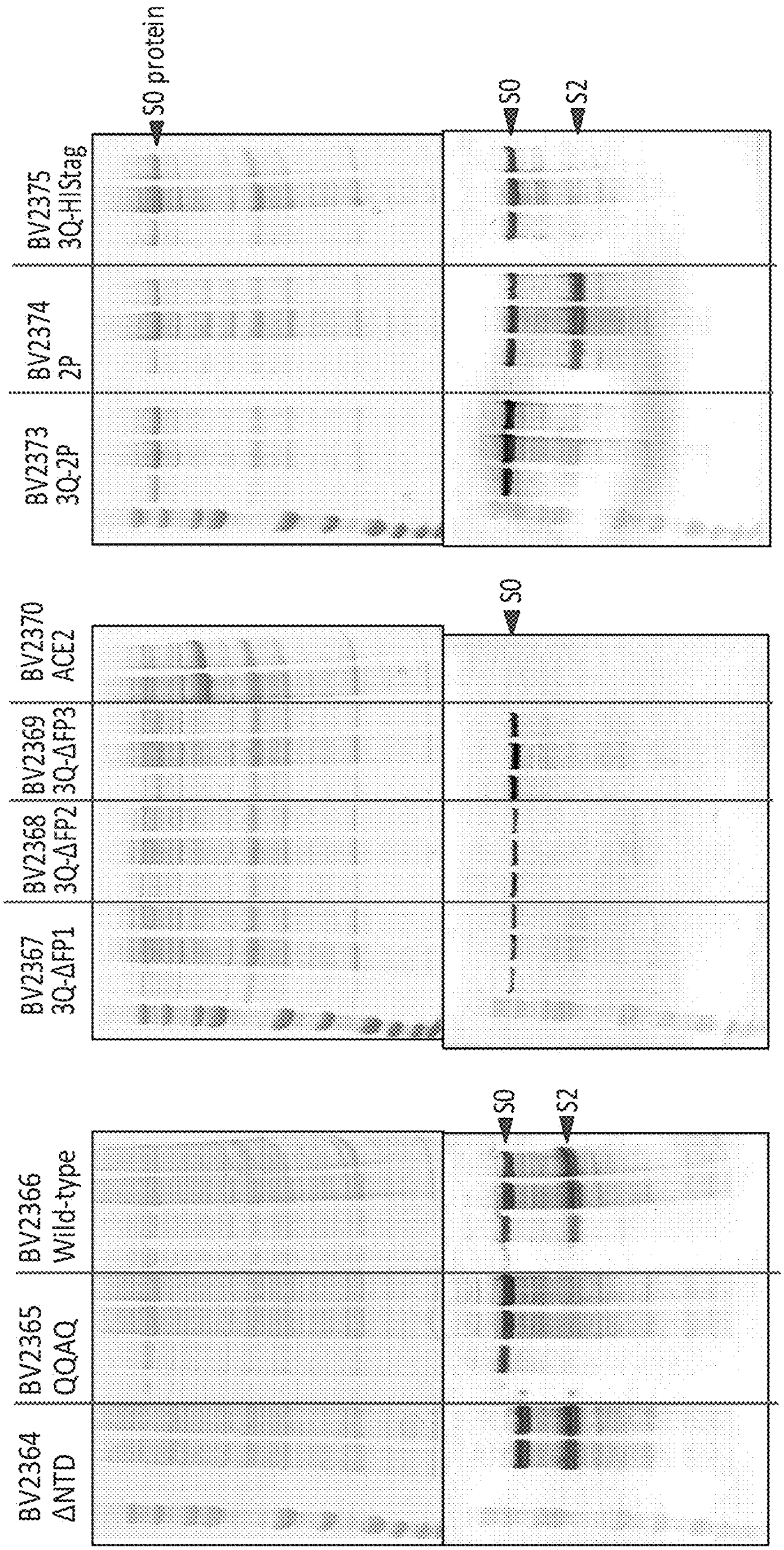
FIG. 2 shows purification of the CoV S polypeptides BV2364, BV2365, BV2366, BV2367, BV2368, BV2369, BV2373, BV2374, and BV2375. The data reveal that BV2365 (SEQ ID NO: 4) and BV2373 (SEQ ID NO: 87) which has an inactive furin cleavage site having an amino acid sequence of QQAQ (SEQ ID NO: 7) is expressed as a single chain (S0). In contrast, CoV S polypeptides containing an intact furin cleavage site (e.g. BV2364, BV2366, and BV2374) are cleaved, as evident by the presence of the cleavage product S2.

As used herein, and in the appended claims, the singular forms “a”, “an”, and “the” include plural referents unless the context clearly dictates otherwise. Thus, for example, reference to “a protein” can refer to one protein or to mixtures of such protein, and reference to “the method” includes reference to equivalent steps and/or methods known to those skilled in the art, and so forth.

As used herein, the term “adjuvant” refers to a compound that, when used in combination with an immunogen, augments or otherwise alters or modifies the immune response induced against the immunogen. Modification of the immune response may include intensification or broadening the specificity of either or both antibody and cellular immune responses.

As used herein, the term “about” or “approximately” when preceding a numerical value indicates the value plus or minus a range of 10%. For example, “about 100” encompasses 90 and 110.

As used herein, the terms “immunogen,” “antigen,” and “epitope” refer to substances such as proteins, including glycoproteins, and peptides that are capable of eliciting an immune response.

As used herein, an “immunogenic composition” is a composition that comprises an antigen where administration of the composition to a subject results in the development in the subject of a humoral and/or a cellular immune response to the antigen.

As used herein, a “subunit” composition, for example a vaccine, that includes one or more selected antigens but not all antigens from a pathogen. Such a composition is substantially free of intact virus or the lysate of such cells or particles and is typically prepared from at least partially purified, often substantially purified immunogenic polypeptides from the pathogen. The antigens in the subunit composition disclosed herein are typically prepared recombinantly, often using a baculovirus system.

As used herein, “substantially” refers to isolation of a substance (e.g. a compound, polynucleotide, or polypeptide) such that the substance forms the majority percent of the sample in which it is contained. For example, in a sample, a substantially purified component comprises 85%, preferably 85/6-90%, more preferably at least 95/6-99.5%, and most preferably at least 99% of the sample. If a component is substantially replaced the amount remaining in a sample is less than or equal to about 0.5% to about 10%, preferably less than about 0.5% to about 1.0%.

The terms “treat,” “treatment,” and “treating,” as used herein, refer to an approach for obtaining beneficial or desired results, for example, clinical results. For the purposes of this disclosure, beneficial or desired results may include inhibiting or suppressing the initiation or progression of an infection or a disease; ameliorating, or reducing the development of, symptoms of an infection or disease; or a combination thereof.

“Prevention,” as used herein, is used interchangeably with “prophylaxis” and can mean complete prevention of an infection or disease, or prevention of the development of symptoms of that infection or disease; a delay in the onset of an infection or disease or its symptoms; or a decrease in the severity of a subsequently developed infection or disease or its symptoms.

As used herein an “effective dose” or “effective amount” refers to an amount of an immunogen sufficient to induce an immune response that reduces at least one symptom of pathogen infection. An effective dose or effective amount may be determined e.g., by measuring amounts of neutralizing secretory and/or serum antibodies, e.g., by plaque neutralization, complement fixation, enzyme-linked immunosorbent (ELISA), or microneutralization assay.

As used herein, the term “vaccine” refers to an immunogenic composition, such as an immunogen derived from a pathogen, which is used to induce an immune response against the pathogen. The immune response may include formation of antibodies and/or a cell-mediated response. Depending on context, the term “vaccine” may also refer to a suspension or solution of an immunogen that is administered to a subject to produce an immune response. Preferably, vaccines induces an immune response that is effective at preventing infection from SARS-CoV-2, a SARS-CoV-2 variant thereof, influenza, or a combination thereof.

As used herein, the term "subject" includes humans and other animals. Typically, the subject is a human. For example, the subject may be an adult, a teenager, a child (2 years to 14 years of age), an infant (birth to 2 year), or a neonate (up to 2 months). In particular aspects, the subject is up to 4 months old, or up to 6 months old. In aspects, the adults are seniors about 65 years or older, or about 60 years or older. In aspects, the subject is a pregnant woman or a woman intending to become pregnant. In other aspects, subject is not a human; for example a non-human primate; for example, a baboon, a chimpanzee, a gorilla, or a macaque. In certain aspects, the subject may be a pet, such as a dog or cat.

In aspects, the subject is immunocompromised. In embodiments, the immunocompromised subject is administered a medication that causes immunosuppression. Non-limiting examples of medications that cause immunosuppression include corticosteroids (e.g., prednisone), alkylating agents (e.g., cyclophosphamide), antimetabolites (e.g., azathioprine or 6-mercaptopurine), transplant-related immunosuppressive drugs (e.g., cyclosporine, tacrolimus, sirolimus, or mycophenolate mofetil), mitoxantrone, chemotherapeutic agents, methotrexate, tumor necrosis factor (TNF)-blocking agents (e.g., etanercept, adalimumab, infliximab). In embodiments, the immunocompromised subject is infected with a virus (e.g., human immunodeficiency virus or Epstein-Barr virus). In embodiments, the virus is a respiratory virus, such as respiratory syncytial virus, influenza, parainfluenza, adenovirus, or a picornavirus. In embodiments, the immunocompromised subject has acquired immunodeficiency syndrome (AIDS). In embodiments, the immunocompromised subject is a person living with human immunodeficiency virus (HIV). In embodiments, the immunocompromised subject is immunocompromised due to a treatment regimen designed to prevent inflammation or prevent rejection of a transplant. In embodiments, the immunocompromised subject is a subject who has received a transplant. In embodiments, the immunocompromised subject has undergone radiation therapy or a splenectomy. In embodiments, the immunocompromised subject has been diagnosed with cancer, an autoimmune disease, tuberculosis, a substance use disorder (e.g., an alcohol, opioid, or cocaine use disorder), stroke or cerebrovascular disease, a solid organ or blood stem cell transplant, sickle cell disease, thalassemia, autoimmune lymphoproliferative syndrome (ALPS), autoimmune polyglandular syndrome type 1 (APS-1), B-cell expansion with NF-κB and T-cell anergy (BENTA) disease, capsase eight deficiency state (CEDS), chronic granulomatous disease (CGD), common variable immunodeficiency (CVID), congenital neutropenia syndromes, a deficiency in the cytotoxic T-lymphocyte-associated antigen 4 (CTLA-4), a DOCK8 deficiency, a GATA2 deficiency, a glycosylation disorder with immunodeficiency, a hyper-immunoglobulin E syndrome (HIES), hyper-immunoglobulin M syndrome, diabetes, type 1 diabetes, type 2 diabetes, interferon gamma deficiency, interleukin 12 deficiency, interleukin 23 deficiency, leukocyte adhesion deficiency, lipopolysaccharide-responsive beige-like anchor (LRBA) deficiency, PI3 kinase disease, PLCG2-associated antibody deficiency and immune dysregulation (PLAID), severe combined immunodeficiency (SCID), STAT3 dominant-negative disease, STAT3 gain-of-function disease, warts, hypogammaglobulinemia, infections, and myelokathexis (WHIM) syndrome, Wisckott-Aldrich syndrome (WAS), X-linked agammaglobulinemia (XLA), X-linked lymphoproliferative disease (XLP), uremia, malnutrition, or XMEN disease. In embodiments, the immunocompromised subject is a current or former cigarette smoker. In embodiments, the immunocompromised subject has a B-cell defect, T-cell defect, macrophage defect, cytokine defect, phagocyte deficiency, phagocyte dysfunction, complement deficiency or a combination thereof.

In embodiments, the subject is overweight or obese. In embodiments, an overweight subject has a body mass index (BMI)≥25 kg/$m^2$ and <30 kg/$m^2$. In embodiments, an obese subject has a BMI that is ≥30 kg/$m^2$. In embodiments, the subject has a mental health condition. In embodiments, the mental health condition is depression, schizophrenia, or anxiety.

As used herein, the term "pharmaceutically acceptable" means being approved by a regulatory agency of a U.S. Federal or a state government or listed in the U.S. Pharmacopeia, European Pharmacopeia or other generally recognized pharmacopeia for use in mammals, and more particularly in humans. These compositions can be useful as a vaccine and/or antigenic compositions for inducing a protective immune response in a vertebrate.

As used herein, the term "about" means plus or minus 10% of the indicated numerical value.

As used herein, the term "NVX-CoV2373" refers to a vaccine composition comprising the BV2373 Spike glycoprotein (SEQ ID NO: 87) and Fraction A and Fraction C iscom matrix (e.g., MATRIX-M™).

As used herein, "Quad-NIV," "QuadNIV" or "quadrivalent nanoparticle influenza vaccine" or "qNIV" refers to influenza vaccine formulations containing antigens from four influenza virus strains.

As used herein, the term "modification" as it refers to a CoV S polypeptide refers to mutation, deletion, or addition of one or more amino acids of the CoV S polypeptide. The location of a modification within a CoV S polypeptide can be determined by aligning the sequence of the polypeptide to SEQ ID NO: 1 (CoV S polypeptide containing signal peptide) or SEQ ID NO: 2 (mature CoV S polypeptide lacking a signal peptide).

The term variant of SARS-CoV-2 used interchangeably herein with a "heterogeneous SARS-CoV-2 strain" is a SARS-CoV-2 virus comprising a CoV S polypeptide having at least about 2, at least about 3, at least about 4, at least about 5, at least about 6, at least about 7, at least about 8, at least about 9, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, at least about 30, at least about 31, at least about 32, at least about 33, at least about 34, or at least about 35 modifications, between about 2 and about 35 modifications, between about 5 and about 10 modifications, between about 5 and about 20 modifications, between about 10 and about 20 modifications, between about 15 and about 25 modifications, between about 20 and 30 modifications, between about 20 and about 40 modifications, between about 25 about 45 modifications, as compared to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with at least about 70%, at least about 75%, at least about 80%, at least about 85%, at least about 90%, at least about 95%, at least about 96%, at least about 97%, at least about 98%, or at least about 99% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 70% and about 99.9% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 70% and about 99.5% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 90% and about 99.9% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 90% and about 99.8% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 95% and about 99.9% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 95% and about 99.8% identity to a CoV S polypeptide having the amino acid sequence of SEQ ID NO: 1 or SEQ ID NO: 2. In embodiments, the heterogeneous SARS-CoV-2 strain is a SARS-CoV-2 virus comprising a CoV S polypeptide with between about 95% and about 99% identity to a CoV S polypeptide having the amino acid sequence of SEQ ID NO: 1 or SEQ ID NO: 2.

The term "B.1.1.7 SARS-CoV-2 strain" (also referred to as an "alpha" strain) refers to a heterogenous SARS-CoV-2 strain having a CoV S polypeptide comprising deletions of amino acids 69, 70, and 144 and mutations of N501Y, A570D, D614G, P681H or P681R, T7161, S982A, and D1118H, wherein the CoV S polypeptide is numbered with respect to the wild-type SARS-CoV-2 S polypeptide having the amino acid sequence of SEQ ID NO: 1. The CoV S polypeptide of a B.1.1.7 SARS-CoV-2 strain may optionally contain a deletion of amino acid 145, mutation of E484K, L432R, or S494P, or a combination thereof.

The term "B.1.351 SARS-CoV-2 strain" (also referred to as a "beta" strain) refers to a heterogenous SARS-CoV-2 strain having a CoV S polypeptide comprising mutations of D80A, K417N, E484K, N501Y, D614G, and A701V, wherein the CoV S polypeptide is numbered with respect to the wild-type SARS-CoV-2 S polypeptide having the amino acid sequence of SEQ ID NO: 1. The CoV S polypeptide of a B.1.617.2 SARS-CoV-2 strain may optionally contain one or more of the following mutations: D215G; L242H; R246I; or deletion of 1, 2, or 3 amino acids of 241-243, wherein the CoV S polypeptide is numbered with respect to the wild-type SARS-CoV-2 S polypeptide having the amino acid sequence of SEQ ID NO: 1. In embodiments, the beta strain's CoV S polypeptide comprises mutations of D80A, D215G, L242H, K417N, E484K, N501Y, D614G, and A701V, wherein the CoV S polypeptide is numbered with respect to the wild-type SARS-CoV-2 S polypeptide having the amino acid sequence of SEQ ID NO: 1. In embodiments, the beta strain's CoV S polypeptide comprises mutations of D80A, D215G, deletion of 1, 2, or 3 amino acids of amino acids 241-243, K417N, E484K, N501Y, D614G, and A701V, wherein the CoV S polypeptide is numbered with respect to the wild-type SARS-CoV-2 S polypeptide having the amino acid sequence of SEQ ID NO: 1. In embodiments, the beta strain comprises mutations of D80A, L242H, R246I, N501Y, K417N, E484K, D614G, and A701V, wherein the CoV S polypeptide is numbered with respect to the wild-type SARS-CoV-2 S polypeptide having the amino acid sequence of SEQ ID NO: 1.

The term "P.1 SARS-CoV-2 strain" (also referred to as a "gamma" strain) refers to a heterogenous SARS-CoV-2 strain having a CoV S polypeptide containing the mutations L18F, T20N, P26S, D138Y, R190S, K417T, E484K, N501Y, D614G, H655Y, T1027L, and V1176F, wherein the CoV S polypeptide is numbered with respect to the wild-type SARS-CoV-2 S polypeptide having the amino acid sequence of SEQ ID NO: 1.

The term "Ca1.20C SARS-CoV-2 strain" refers to a heterogeneous SARS-CoV-2 strain having a CoV S polypeptide containing the mutations S131, W152C, and L452R, wherein the CoV S polypeptide is numbered with respect to the wild-type SARS-CoV-2 S polypeptide having the amino acid sequence of SEQ ID NO: 1.

The term "B.1.617.2 strain" (also referred to as "delta" strain) refers to a heterogeneous SARS-CoV-2 strain having a CoV S polypeptide comprising deletions of amino acids 157 and 158 and mutations of T19R, E156G, L452R, T478K, D614G, P681R, and D950N, wherein the CoV S polypeptide is numbered with respect to the wild-type SARS-CoV-2 S polypeptide having the amino acid sequence of SEQ ID NO: 1. The CoV S polypeptide of a B.1.617.2 SARS-CoV-2 strain may optionally contain one or more of the following mutations: G142D; W64H; H66W; V70F; T95I; Y145H; D213V; L214R; A222V; W258I or W258L; K417N; N439K; E484K or E484Q; N501Y; and Q613H, wherein the CoV S polypeptide is numbered with respect to the wild-type SARS-CoV-2 S polypeptide having the amino acid sequence of SEQ ID NO: 1. In embodiments, the delta strain comprises a CoV S polypeptide comprising deletions of amino acids 157 and 158 and mutations of T19R, G142D, E156G, L452R, T478K, D614G, P681R, and D950N. In embodiments, the delta strain comprises a CoV S polypeptide comprising deletions of amino acids 157 and 158 and mutations of T19R, T951, G142D, Y145H, E156G, A222V, K417N L452R, T478K, D614G, P681R, and D950N, wherein the CoV S polypeptide is numbered with respect to the wild-type SARS-CoV-2 S polypeptide having the amino acid sequence of SEQ ID NO: 1. In embodiments, the delta strain comprises a CoV S polypeptide comprising deletions of amino acids 157 and 158 and mutations of T19R, G142D, E156G, W258I, K417N, N439K, L452R, T478K, E484K, N501Y, D614G, P681R, and D950N, wherein the CoV S polypeptide is numbered with respect to the wild-type SARS-CoV-2 S polypeptide having the amino acid sequence of SEQ ID NO: 1. In embodiments, the delta strain comprises a CoV S polypeptide comprising deletions of amino acids 157 and 158 and mutations of T19R, W64H, H66W, G142D, E156G, D213V, L214R, W258I, K417N, N439K, L452R, T478K, E484K, N501Y, D614G, P681R, and D950N, wherein the CoV S polypeptide is numbered with respect to the wild-type SARS-CoV-2 S polypeptide having the amino acid sequence of SEQ ID NO: 1. In embodiments, the delta strain comprises a CoV S polypeptide comprising deletions of amino acids 157 and 158 and mutations of T19R, G142D, E156G, K417N, L452R, T478K, E484Q, D614G, P681R, and D950N, wherein the CoV S polypeptide is numbered with respect to the wild-type SARS-CoV-2 S polypeptide having the amino acid sequence of SEQ ID NO: 1.

The term "B.1.525 strain" (also referred to as "eta" strain) refers to a heterogeneous SARS-CoV-2 strain having a CoV S polypeptide containing the mutations Q52R; A67V;

E484K; D614G; Q677H; F888L; and deletion of 1, 2, 3, or 4 of amino acids 69, 70, 144, 145, wherein the CoV S polypeptide is numbered with respect to the wild-type SARS-CoV-2 S polypeptide having the amino acid sequence of SEQ ID NO: 1.

The term "B.1.526 strain" (also referred to as "iota" strain) refers to a heterogeneous SARS-CoV-2 strain having a CoV S polypeptide containing the mutations L5F; T95I; D253G; E484K; D614G; and A701V, wherein the CoV S polypeptide is numbered with respect to the wild-type SARS-CoV-2 S polypeptide having the amino acid sequence of SEQ ID NO: 1.

The term "B.1.617.1 strain" (also referred to as "kappa" strain) refers to a heterogeneous SARS-CoV-2 strain having a CoV S polypeptide containing the mutations L452R; E484Q; D614G; P681R; and Q1071H, wherein the CoV S polypeptide is numbered with respect to the wild-type SARS-CoV-2 S polypeptide having the amino acid sequence of SEQ ID NO: 1.

The term "C.37 strain" (also referred to as "lambda" strain) refers to a heterogeneous SARS-CoV-2 strain having a CoV S polypeptide containing the mutations G75V; T76I; R246N; L452Q; F490S; D614G; T859N; and deletion of 1, 2, 3, 4, 5, or 6 of amino acids 247-253, wherein the CoV S polypeptide is numbered with respect to the wild-type SARS-CoV-2 S polypeptide having the amino acid sequence of SEQ ID NO: 1.

The term "B.1.621 strain" (also referred to as "mu" strain) refers to a heterogeneous SARS-CoV-2 strain having a CoV S polypeptide containing the mutations T95I; Y144S; Y145N; R346K; E484K; N501Y; D614G; P681H; and D950N, wherein the CoV S polypeptide is numbered with respect to the wild-type SARS-CoV-2 S polypeptide having the amino acid sequence of SEQ ID NO: 1.

The term "B.1.1.529 strain" used interchangeably with "omicron" variant refers to a heterogeneous SARS-CoV-2 strain having a CoV S polypeptide comprising the mutations G142D; G339D; S373P; S375F; K417N; N440K; T478K; E484A or E484K; Q493K or Q493R; Q498R; N501Y; Y505H; D614G; H655Y; N679K; P681H; N764K; D796Y; Q954H; and N969K; wherein the CoV S polypeptide is numbered with respect to the wild-type SARS-CoV-2 S polypeptide having the amino acid sequence of SEQ ID NO: 1. The CoV S polypeptide of a B.1.1.529 SARS-CoV-2 strain may optionally contain one or more of the following mutations: T19I; L24S; A67V; T951; N2111; L2121 or L212V; V213P or V213G; R214E; S371L; T376A; D405N; R408S; G446S; S477N; G496S; T547K; N856K; L981F; G496S; insertion of amino acids PPA after amino acid 25; insertion of amino acids EPE after amino acid 214 or 215; or deletion of one or more of amino acids 25, 26, 27, 69, 70, 143, 144, 145, 211, 212; wherein the CoV S polypeptide is numbered with respect to the wild-type SARS-CoV-2 S polypeptide having the amino acid sequence of SEQ ID NO: 1. Optionally, the SARS-CoV-2 S omicron variant is the SARS-CoV-2 S omicron BA.1 variant. This strain comprises the following mutations in the SARS-CoV-2 S polypeptide, wherein the polypeptide is numbered with respect to SEQ ID NO: 1: A67V; deletion of amino acids 69-70; T95I; G142D; deletion of amino acids 143-145; N2111; deletion of amino acid 212; insertion of amino acids EPE after amino acid 214; G339D; S371L; S373P; S375F; K417N; N440K; G446S; S477N; T478K; E484A; Q493R; G496S; Q498R; N501Y; Y505H; T547K; D614G; H655Y; N679K; P681H; N764K; D796Y; N856K; Q954H; N969K; and L981F. Optionally, the SARS-CoV-2 S omicron variant is the SARS-CoV-2 S omicron BA.2 variant. This strain comprises the following mutations in the SARS-CoV-2 S polypeptide, wherein the polypeptide is numbered with respect to SEQ ID NO: 1: T19I; L24S; deletion in amino acids 25-27; G142D; V213G; G339D; S371F; S373P; S375F; T376A; D405N; R408S; K417N; N440K; S477N; T478K; E484A; Q493R; Q498R; N501Y; Y505H; D614G; H655Y; N679K; P681H; N764K: D796Y; Q954H; and N969K.

A subject that is "positive" for SARS-CoV-2 or a variant thereof has a positive PCR or serological test for SARS-CoV-2 or a variant thereof. A positive PCR test detects genetic material from SARS-CoV-2 or a variant thereof. A positive serological test shows the presence of antibodies against a SARS-CoV-2 protein, typically the nucleocapsid protein from SARS-CoV-2 or a variant thereof.

The term "asymptomatic" refers to a subject that is positive for SARS-CoV-2 or a SARS-CoV-2 variant thereof, but does not experience any symptoms of COVID-19.

The term "mild" as it refers to COVID-19 refers to a subject that has a positive PCR or serological test for SARS-CoV-2 or a variant thereof and has one or more of the following symptoms: (i) fever; (ii) new onset cough; (iii) or two additional COVID-19 symptoms selected from new onset or worsening of shortness of breath or difficulty breathing; fatigue; generalized muscle or body aches; headache; loss of taste or smell; sore throat, congestion, or runny nose, or nausea, vomiting, or diarrhea.

The term "moderate" as it refers to COVID-19 refers to a subject that has a positive PCR or serological test for SARS-CoV-2 or a variant thereof and one or more of the following symptoms: (i) a high fever of ≥38.4° C. for three or more days; (ii) any evidence of significant lower respiratory tract infection (LRTI), wherein the evidence is selected from: (a) shortness of breath with or without exertion; (b) tachypnea (24 to 29 breaths per minute at rest); (c) SpO2 of 94% to 95%; (d) an abnormal chest x-ray or computerized tomography (CT) consistent with pneumonia or LRTI; or (e) adventitious sounds on lung auscultation (e.g., crackles/rales, wheeze, rhonchi, pleural rub, stridor).

The term "severe" as it refers to COVID-19 refers to a subject that has a positive PCR or serological test for SARS-CoV-2 or a variant thereof and one or more of the following symptoms: (i) tachypnea of ≥30 breaths per minute at rest; (ii) resting heart rate of ≥125 beats per minute; (iii) SpO2 of ≤93% or PaO2/FiO2<300 mmHg: (iv) requirement for high flow oxygen therapy or non-invasive ventilation, non-invasive positive pressure ventilation (e.g., continuous positive airway pressure (CPAP) or bilevel positive airway pressure (BiPAP)); (v) requirement for mechanical ventilation or extracorporeal membrane oxygenation (ECMO); (vi) one or more major organ system dysfunctions or failure selected from (a) acute respiratory failure, including acute respiratory distress syndrome (ARDS); (b) acute renal failure; (c) acute hepatic failure; (d) acute right or left heart failure; (e) septic or cardiogenic shock (with shock defined as systolic blood pressure (SBP) of <90 mmHg or diastolic blood pressure (DBP) or <60 mmHg); (f) acute stroke (ischemic or hemorrhagic); (g) acute thrombotic event, such as acute myocardial infarction (AMI), deep vein thrombosis (DVT), or pulmonary embolism (PE); (h) a requirement for vasopressors, systemic corticosteroids, or hemodialysis; (vii) admission to an intensive care unit; or (viii) death.

As used herein, the terms "bedside mix," "bedside formulations," "bedside vaccine compositions," "bedside vials," "bedside vial formulations" refer to vaccine formulations that are prepared immediately prior to administration. Such vaccine formulations contain viral antigens and adjuvants that are separately stored in different containers and are administered to a subject (e.g., either administering two consecutive injections, or combining the antigens and the adjuvants into one injection prior to administration).

As used herein, the terms "co-formulation mix," "co-formulation," "co-formulation vaccine compositions," "pre-filled syringes," "pre-mix," refer to vaccine formulations that are prepared for short to long-term storage prior to the time of administration to a subject. Such vaccine formulations contain a combination of antigens and adjuvant in the same container and prepared in advance of administration. In embodiments, formulations contain hemagglutinin and adjuvant (e.g., saponin adjuvant) form HaSMaNs (Hemagglutinin Saponin Matrix Nanoparticles).

The term "efficacy" of an immunogenic composition or vaccine composition described herein refers to the percentage reduction of disease (e.g., COVID-19) in a group administered an immunogenic composition as compared to a group that is not administered the immunogenic composition. In embodiments, efficacy (E) is calculated using the following equation: $E\ (\%)=(1-RR)\times 100$, where RR=relative risk of incidence rates between the group administered the immunogenic composition and the group that is not administered the immunogenic composition. In embodiments, immunogenic compositions described herein have an efficacy against a SARS-CoV-2 virus or heterogeneous SARS-CoV-2 strain that is at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, at least about 99%, between about 50% and about 99%, between about 50% and about 98%, between about 60% and about 99%, between about 60% and about 98%, between about 70% and about 98%, between about 70% and about 95%, between about 70% and about 99%, between about 80% and about 99%, between about 80% and about 98%, between about 80% and about 95%, between about 85% and about 99%, between about 85% and about 98%, between about 85% and about 95%, between about 90% and about 95%, between about 90% and 98%, or between about 90% and about 99%.

As used herein, the term "split-virion" refers to a virus (e.g., an influenza virus or a SARS-CoV-2 virus), which has a viral membrane that has been disrupted with a surfactant. Examples of surfactants are described throughout this disclosure. Split-virions do not undergo further purification, so they typically contain multiple viral proteins.

As used herein, the term "recombinant" as it refers to a protein (e.g. hemagglutinin) that is produced in a cell by transcription and translation of a nucleic acid that is introduced into a cell. The nucleic acid may be introduced via a vector or a virus encoding the nucleic acid.

As used herein, the term "whole influenza virus" refers to a virus that comprises all of its envelope, viral membrane, nucleocapsid, and genetic material. In embodiments, the whole influenza virus is inactivated.

As used herein, the term "inactivated virus" refers to a virus that has undergone treatment to substantially reduce or eliminate its virulence compared to the wild-type virus.

Immunogenic Compositions Against Coronaviruses and Influenza Viruses

Provided herein are immunogenic compositions and vaccine compositions containing (i) at least three hemagglutinin (HA) glycoproteins, wherein the three hemagglutinin (HA) glycoproteins are from different influenza strains; (ii) a CoV S polypeptide in the form of a detergent-core nanoparticle, wherein the detergent is a non-ionic detergent, and (iii) a pharmaceutically acceptable buffer. In embodiments, the at least three HA glycoproteins are in a form selected from the group consisting of (a) detergent-core nanoparticles comprising hemagglutinin (HA); (b) HaSMaNs (Hemagglutinin Saponin Matrix Nanoparticles); (c) an inactivated whole influenza virus; (d) a hemagglutinin composition extracted from an influenza virus; optionally an influenza split-virion composition or a subunit influenza composition; and any combination thereof. In embodiments, provided herein are methods of using the aforementioned immunogenic compositions and vaccine compositions to stimulate an immune response against a coronavirus, an influenza virus, or a combination thereof.

Also provided herein are methods of manufacturing the aforementioned nanoparticles and immunogenic compositions. Advantageously, the methods provide nanoparticles that are substantially free from contamination by other proteins, such as proteins associated with recombinant expression of proteins in insect cells. In embodiments, expression occurs in baculovirus/Sf9 systems.

(i) Non-Naturally Occurring CoV S Polypeptides or Nanoparticles

The immunogenic compositions of the disclosure contain non-naturally occurring CoV S polypeptides or nanoparticles comprising the same. CoV S polypeptides may be derived from coronaviruses, including but not limited to SARS-CoV-2, for example from SARS-CoV-2, from MERS CoV, and from SARS CoV.

In embodiments, the variant of SARS-CoV-2 is SARS-CoV-2 VUI 202012/01, B.1.1.7 (also called "501Y.V1" and "alpha"), B.1.351 (also called "501Y.V2" and "beta"), B.1.617.2 (also called "delta"), Ca1.20C (also called "epsilon"), or P.1 (also called "gamma"). The variant of SARS-CoV-2 is designated by a World Health Organization (WHO) label (e.g., alpha, beta, gamma, delta, etc.), by its Phylogenetic Assignment of Named Global Outbreak (PANGO) lineage, by its GISAID clade, or by its Nextstrain clade.

The table below provides a list of variant SARS-CoV-2 strains:

| WHO label | Pango lineage* | GISAID clade | Nextstrain clade | Modifications compared to SEQ ID NO: 1 | Optional Modifications compared to SEQ ID NO: 1 |
|---|---|---|---|---|---|
| Alpha | B.1.1.7 | GRY | 20I (V1) | Deletion of amino acids 69 and 70; deletion of amino acids 144; N501Y; A570D; D614G; P681H or P681R, T716I; | Deletion of amino acid 145; E484K; L432R, S494P |

-continued

| WHO label | Pango lineage* | GISAID clade | Nextstrain clade | Modifications compared to SEQ ID NO: 1 | Optional Modifications compared to SEQ ID NO: 1 |
|---|---|---|---|---|---|
| | | | | S982A; and D1118H | |
| Beta | B.1.351 | GH/501Y.V2 | 20H (V2) | D80A; K417N; E484K; N501Y; D614G; A701V; | D215G; L242H; R246I; Deletion of 1, 2, or 3 amino acids of 241-243 |
| Gamma | P.1 | GR/501Y.V3 | 20J (V3) | L18F; T20N; P26S, D138Y; R190S; K417T; E484K; N501Y; D614G; H655Y; T1027I; and V1176F | |
| Delta | B.1.617.2 | G/478K.V1 | 21A, 21I, 21J | T19R; E156G; deletion of amino acids 157 and 158; L452R; T478K; D614G; P681R; D950N | G142D; W64H; H66W; V70F; T95I; Y145H; D213V; L214R; A222V; W258I or W258L; K417N; N439K; E484K or E484Q; N501Y; Q613H |
| Eta | B.1.525 | | | Q52R; A67V; deletions of amino acids 69-70; deletions of amino acids 144-145; E484K; D614G; Q677H; F888L | |
| Iota | B.1.526 | | | L5F, T95I, D253G; E484K; D614G; A701V | |
| Kappa | B.1.617.1 | | | L452R; E484Q; D614G; P681R; Q1071H | |
| Lambda | C.37 | | | G75V, T76I, R246N, deletion of 1, 2, 3, 4, 5, or 6 amino acids of 247-253; L452Q; F490S; D614G; T859N | |
| Mu | B.1.621 | | | T95I; Y144S; Y145N; R346K; E484K; N501Y; D614G; P681H; D950N | |

In embodiments, the SARS-CoV-2 virus has a CoV S polypeptide having the amino acid sequence of SEQ ID NO: 1, and the variant of SARS-CoV-2 comprises a CoV S polypeptide having at least about 1, at least about 2, at least about 3, at least about 4, at least about 5, at least about 6, at least about 7, at least about 8, at least about 9, at least about 10, at least about 11, at least about 12, at least about 13, at least about 14, at least about 15, at least about 16, at least about 17, at least about 18, at least about 19, at least about 20, at least about 21, at least about 22, at least about 23, at least about 24, at least about 25, at least about 26, at least about 27, at least about 28, at least about 29, at least about 30, at least about 31, at least about 32, at least about 33, at least about 34, at least about 35, at least about 36, at least about 37, at least about 38, at least about 39, at least about 40, at least about 41, at least about 42, at least about 43, at least about 44, at least about 45, at least about 46, at least about 47, at least about 48, at least about 49, at least about 50, at least about 51, at least about 52, at least about 53, at least about 54, at least about 55, at least about 56, at least about 57, at least about 58, at least about 59, at least about 60, at least about 61, at least about 62, at least about 63, at least about 64, at least about 65, at least about 66, at least about 67, at least about 68, at least about 69, or at least about 70 modifications compared to SEQ ID NO: 1.

In contrast to the SARS-CoV S protein, the SARS-CoV-2 S protein has a four amino acid insertion in the S1/S2 cleavage site resulting in a polybasic RRAR furin-like cleavage motif. The SARS-CoV-2 S protein is synthesized as an inactive precursor (S0) that is proteolytically cleaved at the furin cleavage site into S1 and S2 subunits which remain non-covalently linked to form prefusion trimers. The S2 domain of the SARS-CoV-2 S protein comprises a fusion peptide (FP), two heptad repeats (HR1 and HR2), a trans-membrane (TM) domain, and a cytoplasmic tail (CT). The S1 domain of the SARS-CoV-2 S protein folds into four distinct domains: the N-terminal domain (NTD) and the C-terminal domain, which contains the receptor binding domain (RBD) and two subdomains SD1 and SD2. The prefusion SARS-CoV-2 S protein trimers undergo a structural rearrangement from a prefusion to a postfusion conformation upon S-protein receptor binding and cleavage.

Figure 3:
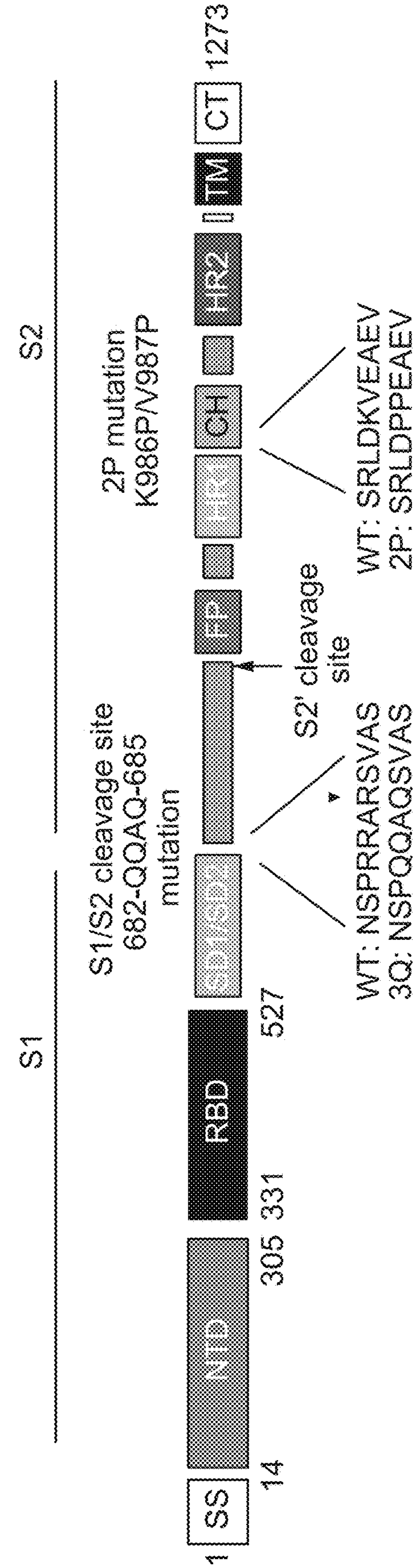
FIG. 3 shows the primary structure of the BV2373 CoV S polypeptide and modifications to the furin cleavage site, K986P, and V987P.
Figure 6A:
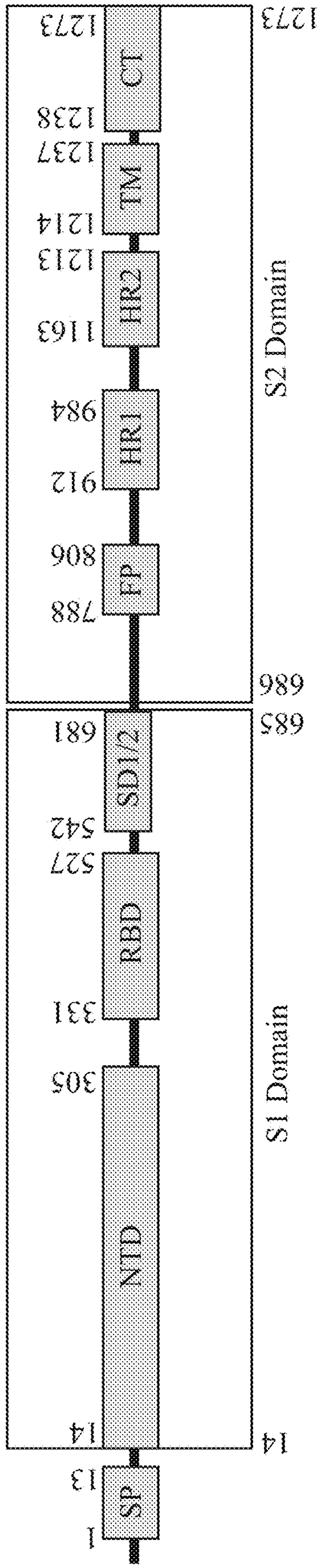
FIG. 6A shows the primary structure of a wild-type SARS-CoV-2 S polypeptide, containing a signal peptide, numbered with respect to SEQ ID NO: 1.
Figure 6B:
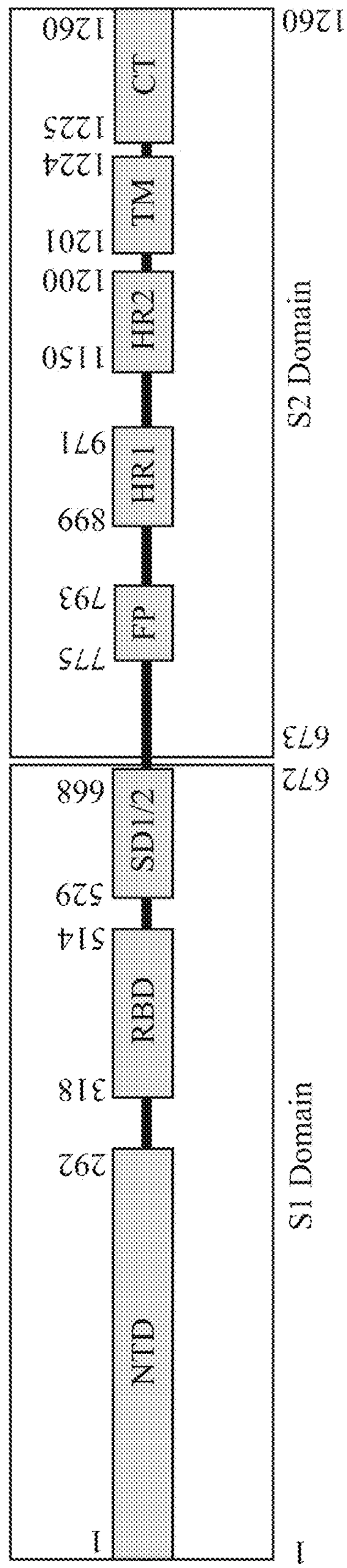
FIG. 6B shows the primary structure of a wild-type SARS-CoV-2 S polypeptide, without a signal peptide, numbered with respect to SEQ ID NO: 2.

In embodiments, the CoV S polypeptides are glycoproteins, due to post-translational glycosylation. The glycoproteins comprise one or more of a signal peptide, an S1 subunit, an S2 subunit, a NTD, a, RBD, two subdomains (SD1 and SD2, labeled SD1/2 in FIGS. 6A-B and referred to as "SD1/2" herein), an intact or modified fusion peptide, an HR1 domain, an HR2 domain, a TM, and a CD. In embodiments, the amino acids for each domain are given in FIG. 6A (shown according to SEQ ID NO: 1) and FIG. 6B (shown according to SEQ ID NO: 2). In embodiments, each domain may have at least 95%, at least 96%, at least 97%, at least 98%, at least 99%, or at least 99.5% identity to the sequences for each domain as in SEQ ID NO: 1 or SEQ ID NO: 2. Each domain may have a deletion, an insertion, or mutation of up to about 1, up to about 2, up to about 3, up to about 4, up to about 5, up to about 10, up to about 20, or up to about 30 amino acids compared to those shown in SEQ ID NO: 1 or SEQ ID NO: 2. Each domain may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to those shown in SEQ ID NO: 1 or SEQ ID NO: 2. Note that FIGS. 2 and 3 illustrate the 13-amino acid N-terminal signal peptide that is absent from the mature peptide. The CoV S polypeptides may be used to stimulate immune responses against the native CoV Spike (S) polypeptide.

In embodiments, the native CoV Spike (S) polypeptide (SEQ ID NO: 2) is modified resulting in non-naturally occurring CoV Spike (S) polypeptides In embodiments, the native CoV Spike (S) polypeptide (SEQ ID NO: 2) is modified resulting in non-naturally occurring CoV Spike (S) polypeptides (FIG. 1). In embodiments, the CoV Spike (S) glycoproteins comprise a S1 subunit and a S2 subunit, wherein the S1 subunit comprises an NTD, an RBD, a SD1/2, and an inactive furin cleavage site (amino acids 669-672), and wherein the S2 subunit comprises mutations of amino acids 973 and 974;

wherein the NTD (amino acids 1-318) optionally comprises one or more modifications selected from the group consisting of:

(a) deletion of one or more amino acids selected from the group consisting of amino acid 56, 57, 131, 132, 144, 145, 228, 229, 230, 231, 234, 235, 236, 237, 238, 239, 240 and combinations thereof;

(b) insertion of 1, 2, 3, or 4 amino acids after amino acid 132; and (c) mutation of one or more amino acids selected from the group consisting of amino acid 5, 6, 7, 13, 39, 51, 53, 54, 56, 57, 62, 63, 67, 82, 125, 129, 131, 132, 133, 139, 143, 144, 145, 177, 200, 201, 202, 209, 229, 233, 240, 245, and combinations thereof;

wherein the RBD optionally comprises mutation of one or more amino acids selected from the group consisting of amino acid 333, 404, 419, 426, 439, 440, 464, 465, 471, 477, 481, 488, and combinations thereof;

wherein the SD1/2 domain optionally comprises mutation of one or more amino acids selected from the group consisting of 557, 600, 601, 642, 664, 668, and combinations thereof; and wherein the S2 subunit optionally comprises one or more modifications selected from the group consisting of:

(a) deletion of one or more amino acids from 676-685, 676-702, 702-711, 775-793, 806-815 and combinations thereof;

(b) mutation of one or more amino acids selected from the group consisting of 688, 703, 846, 875, 937, 969, 973, 974, 1014, 1058, 1105, and 1163 and combinations thereof; and (c) deletion of one or more amino acids from the transmembrane and cytoplasmic domain (TMCT) (amino acids 1201-1260), wherein the amino acids of the CoV S glycoprotein are numbered with respect to SEQ ID NO: 2.

In embodiments, the CoV S polypeptides described herein exist in a prefusion conformation. In embodiments, the CoV S polypeptides described herein comprise a flexible HR2 domain. Unless otherwise mentioned, the flexibility of a domain is determined by transition electron microscopy (TEM) and 2D class averaging. A reduction in electron density corresponds to a flexible domain.

Modifications to S1 Subunit

In embodiments, the CoV S polypeptides contain one or more modifications to the S1 subunit having an amino acid sequence of SEQ ID NO: 121.

The amino acid sequence of the S1 subunit (SEQ ID NO: 121) is shown below

```
QCVNLTTRTQLPPAYTNSFTRGVYYPDKVFRSSVLHSTQDLFLPFFSNV

TWFHAIHVSGTNGTKRFDNPVLPFNDGVYFASTEKSNIIRGWIFGTTLD

SKTQSLLIVNNATNVVIKVCEFQFCNDPFLGVYYHKNNKSWMESEFRVY

SSANNCTFEYVSQPFLMDLEGKQGNFKNLREFVFKNIDGYFKIYSKHTP

INLVRDLPQGFSALEPLVDLPIGINITRIQTLLALHRSYLTPGDSSSGW

TAGAAAYYVGYLQPRTFLLKYNENGTITDAVDCALDPLSETKCTLKSFT

VEKGIYQTSNFRVQPTESIVRFPNITNLCPFGEVENATRFASVYAWNRK

RISNCVADYSVLYNSASFSTFKCYGVSPTKLNDLCFTNVYADSFVIRGD

EVRQIAPGQTGKIADYNYKLPDDFTGCVIAWNSNNLDSKVGGNYNYLYR

LFRKSNLKPFERDISTEIYQAGSTPCNGVEGFNCYFPLQSYGFQPTNGV

GYQPYRVVVLSFELLHAPATVCGPKKSTNLVKNKCVNFNFNGLTGTGVL

TESNKKFLPFQQFGRDIADTTDAVRDPQTLEILDITPCSFGGVSVTTPG

TNTSNQVAVLYQDVNCTEVPVAIHADQLTPTWRVYSTGSNVFQTRAGCL

IGAEHVNNSYECDIPIGAGICASYQTQTNSPRRAR
```

In embodiments, the CoV S polypeptides described herein comprise an S1 subunit with at least 95%, at least 96%, at least 97%, at least 98%, at least 99%, or at least 99.5%, identity to the S1 subunit of SEQ ID NO: 1 or SEQ ID NO: 2. The S1 subunit may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the S1 subunit of SEQ ID NO: 1 or SEQ ID NO: 2. The S1 subunit may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the S1 subunit of SEQ ID NO: 1 or SEQ ID NO: 2.

In embodiments, the S1 subunit may contain any combination of modifications shown in Table 1A.

TABLE 1A

Modifications to S1 (SEQ ID NO: 121)

| Position within SEQ ID NO: 1 | Position within SEQ ID NO: 2 | Position within SEQ ID NO: 121 | Potential Modifications |
|---|---|---|---|
| 14-305 | 1-292 | 1-292 | deletion of up to about 1, 2, 3, 4, 5, 10, 20, 30, 40, 50, 60, 70, 80, 90, 100, 110, 120, 130, 140, 150, 160, 170, 180, 190, 200, 210, 220, 230, 240, 250, 260, 270, 280, 290, or 292 amino acids |
| 18 | 5 | 5 | mutation to phenylalanine |
| | | | mutation to tyrosine |
| | | | mutation to tryptophan |
| 19 | 6 | 6 | mutation to arginine |
| | | | mutation to lysine |
| | | | mutation to histidine |
| 20 | 7 | 7 | mutation to asparagine |
| | | | mutation to glutamine |
| | | | mutation to isoleucine |
| | | | mutation to valine |
| 26 | 13 | 13 | mutation to serine |
| | | | mutation to threonine |
| 52 | 39 | 39 | mutation to arginine |
| | | | mutation to lysine |
| | | | mutation to histidine |
| 64 | 51 | 51 | mutation to histidine |
| | | | mutation to lysine |
| | | | mutation to arginine |
| 66 | 53 | 53 | mutation to tryptophan |
| | | | mutation to tyrosine |
| | | | mutation to phenylalanine |
| 67 | 54 | 54 | mutation to valine |
| | | | mutation to isoleucine |
| | | | mutation to leucine |
| 69 | 56 | 56 | Deletion of amino acid |
| 70 | 57 | 57 | Deletion of amino acid |
| | | | Mutation to phenylalanine |
| | | | Mutation to tyrosine |
| | | | Mutation to tryptophan |
| 75 | 62 | 62 | Mutation to valine |
| | | | Mutation to leucine |
| | | | Mutation to isoleucine |
| 76 | 63 | 63 | Mutation to isoleucine |
| | | | Mutation to valine |
| | | | Mutation to leucine |
| 80 | 67 | 67 | mutation to alanine |
| | | | mutation to glycine |
| 95 | 82 | 82 | mutation to beta branched amino acid |
| | | | mutation to isoleucine |
| | | | mutation to valine |
| 138 | 125 | 125 | mutation to tyrosine |
| | | | mutation to phenylalanine |
| | | | mutation to tryptophan |
| 142 | 129 | 129 | mutation to aspartic acid |
| | | | mutation to glutamic acid |
| 144 | 131 | 131 | Deletion of amino acid |
| | | | Mutation to serine |
| 145 | 132 | 132 | Deletion of amino acid |
| | | | Mutation to histidine |
| | | | Mutation to asparagine |
| | | | Mutation to glutamine |

TABLE 1A-continued

Modifications to S1 (SEQ ID NO: 121)

| Position within SEQ ID NO: 1 | Position within SEQ ID NO: 2 | Position within SEQ ID NO: 121 | Potential Modifications |
|---|---|---|---|
| | | | insertion of 1, 2, 3, or 4 amino acids after amino acid 132 (e.g., asparagine) |
| 146 | 133 | 133 | mutation to aromatic amino acid |
| | | | mutation to tyrosine |
| | | | mutation to phenylalanine |
| | | | mutation to tryptophan |
| 152 | 139 | 139 | mutation to cysteine |
| | | | mutation to methionine |
| | | | mutation to serine |
| | | | mutation to threonine |
| 156 | 143 | 143 | mutation to glycine |
| | | | mutation to alanine |
| 157 | 144 | 144 | deletion of amino acid |
| 158 | 145 | 145 | deletion of amino acid |
| 190 | 177 | 177 | mutation to serine |
| | | | mutation to threonine |
| | | | mutation to cysteine |
| 213 | 200 | 200 | mutation to valine |
| | | | mutation to leucine |
| | | | mutation to isoleucine |
| | | | mutation to beta branched amino acid |
| 214 | 201 | 201 | mutation to arginine |
| | | | mutation to lysine |
| | | | mutation to histidine |
| 215 | 202 | 202 | mutation to glycine |
| | | | mutation to alanine |
| 222 | 209 | 209 | mutation to valine |
| | | | mutation to leucine |
| | | | mutation to isoleucine |
| 241-244 | 228-231 | 228-231 | deletion of 1, 2, 3, or 4 amino acids |
| 242 | 229 | 229 | mutation to histidine |
| | | | mutation to lysine |
| | | | mutation to arginine |
| 246 | 233 | 233 | mutation to beta-branched amino acid |
| | | | mutation to isoleucine |
| | | | mutation to valine |
| | | | mutation to threonine |
| | | | mutation to asparagine |
| 247 | 234 | 234 | deletion of amino acid |
| 248 | 235 | 235 | deletion of amino acid |
| 249 | 236 | 236 | deletion of amino acid |
| 250 | 237 | 237 | deletion of amino acid |
| 251 | 238 | 238 | deletion of amino acid |
| 252 | 239 | 239 | deletion of amino acid |
| 253 | 240 | 240 | mutation to glycine |
| | | | deletion of amino acid |
| 258 | 245 | 245 | mutation to isoleucine |
| | | | mutation to valine |
| | | | mutation to leucine |
| | | | mutation to beta branched amino acid |
| 346 | 333 | 333 | mutation to lysine |
| | | | mutation to arginine |
| | | | mutation to histidine |
| 417 | 404 | 404 | mutation to asparagine |
| | | | mutation to threonine |
| | | | mutation to isoleucine |
| | | | mutation to valine |
| | | | mutation to serine |
| | | | mutation to glutamine |
| | | | mutation to beta-branched amino acid |
| 432 | 419 | 419 | mutation to lysine |
| | | | mutation to arginine |
| | | | mutation to histidine |
| 439 | 426 | 426 | mutation to lysine |
| | | | mutation to arginine |
| | | | mutation to histidine |
| 452 | 439 | 439 | mutation to arginine |
| | | | mutation to lysine |
| | | | mutation to histidine |
| | | | mutation to glutamine |
| | | | mutation to asparagine |

TABLE 1A-continued

| Modifications to S1 (SEQ ID NO: 121) | | | |
|---|---|---|---|
| Position within SEQ ID NO: 1 | Position within SEQ ID NO: 2 | Position within SEQ ID NO: 121 | Potential Modifications |
| 453 | 440 | 440 | mutation to phenylalanine<br>mutation to tryptophan |
| 477 | 464 | 464 | mutation to asparagine<br>mutation to glutamine |
| 478 | 465 | 465 | mutation to lysine<br>mutation to arginine<br>mutation to histidine |
| 484 | 471 | 471 | mutation to lysine<br>mutation to arginine<br>mutation to histidine<br>mutation to glutamine<br>mutation to asparagine |
| 490 | 477 | 477 | mutation to serine<br>mutation to threonine |
| 494 | 481 | 481 | mutation to proline |
| 501 | 488 | 488 | mutation to tyrosine<br>mutation to phenylalanine<br>mutation to tryptophan |
| 570 | 557 | 557 | Mutation to aspartic acid<br>Mutation to glutamic acid |
| 613 | 600 | 600 | Mutation to histidine<br>Mutation to lysine<br>Mutation to arginine |
| 614 | 601 | 601 | Mutation to glycine<br>Mutation to alanine |
| 655 | 642 | 642 | Mutation to tyrosine<br>Mutation to phenylalanine<br>Mutation to tryptophan |
| 677 | 664 | 664 | Mutation to histidine |
| 681 | 668 | 668 | Mutation to histidine<br>Mutation to lysine<br>Mutation to arginine |
| 682-685 | 669-672 | 669-672 | inactive furin cleavage site (See Table 1E) |

* amino acids 14-685 of SEQ ID NO: 1 and amino acids 1-672 of SEQ ID NO: 2

Modifications to S1 Subunit-NTD

In embodiments, the CoV S polypeptides contain one or more modifications to the NTD. In embodiments, the NTD has an amino acid sequence of SEQ ID NO: 118, which corresponds to amino acids 14-305 of SEQ ID NO: 1 or amino acids 1-292 of SEQ ID NO: 2.

The amino acid sequence of an NTD (SEQ ID NO: 118) is shown below.

```
QCVNLTTRTQLPPAYTNSFTRGVYYPDKVFRSSVLHSTQDLFLPFFSNV
TWFHAIHVSGTNGTKRFDNPVLPFNDGVYFASTEKSNIIRGWIFGTTLD
SKTQSLLIVNNATNVVIKVCEFQFCNDPFLGVYYHKNNKSWMESEFRVY
SSANNCTFEYVSQPFLMDLEGKQGNFKNLREFVFKNIDGYFKIYSKHTP
INLVRDLPQGFSALEPLVDLPIGINITRFQTLLALHRSYLTPGDSSSGW
TAGAAAYYVGYLQPRTFLLKYNENGTITDAVDCALDPLSETKCTLKS
```

Underlined regions of SEQ ID NO: 118 represent amino acids within the NTD that may be modified.

In embodiments, the NTD has an amino acid sequence of SEQ ID NO: 45, which corresponds to amino acids 14 to 331 of SEQ ID NO: 1 or amino acids 1-318 of SEQ ID NO: 2. The amino acid sequence of an NTD (SEQ ID NO. 45) is shown below.

```
QCVNLTTRTQLPPAYTNSFTRGVYYPDKVFRSSVLHSTQDLFLPFFSNV
TWFHAIHVSGTNGTKRFDNPVLPFNDGVYFASTEKSNIIRGWIFGTTLD
SKTQSLLIVNNATNVVIKVCEFQFCNDPFLGVYYHKNNKSWMESEFRVY
SSANNCTFEYVSQPFLMDLEGKQGNFKNLREFVFKNIDGYFKIYSKHTP
INLVRDLPQGFSALEPLVDLPIGINITRFQTLLALHRSYLTPGDSSSGW
TAGAAAYYVGYLQPRTFLLKYNENGTITDAVDCALDPLSETKCTLKSFT
VEKGIYQTSNFRVQPTESIVRFPN
```

In embodiments, the NTD and RBD overlap by up to about 1 amino acid, up to about 5 amino acids, up to about 10 amino acids, or up to about 20 amino acids.

In embodiments, an NTD as provided herein may be extended at the C-terminus by up to 5, up to 10, up to 15, up to 20, up to 25, or up to 30 amino acids.

In embodiments, the CoV S polypeptides described herein comprise a NTD with at least 95%, at least 96%, at least 97%, at least 98%, at least 99%, or at least 99.5%, identity to the NTD of SEQ ID NO: 1 or SEQ ID NO: 2. The NTD may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the NTD of SEQ ID NO: 1 or SEQ ID NO: 2. The NTD may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the NTD of SEQ ID NO: 1 or SEQ ID NO: 2.

In embodiments, the CoV S polypeptides contain a deletion of one or more amino acids from the N-terminal domain (NTD) (corresponding to amino acids 1-292 of SEQ ID NO: 2. In embodiments, the CoV S polypeptides contain a deletion of up to about 10, 20, 30, 40, 50, 60, 70, 80, 90, 100, 110, 120, 130, 140, 150, 160, 170, 180, 190, 200, 210, 220, 230, 240, 250, 260, 270, 280, 290, or 292 amino acids of the NTD.

In embodiments, the CoV S polypeptides contain a deletion of one or more amino acids from the NTD (corresponding to amino acids 1-318 of SEQ ID NO: 2). In embodiments, the CoV S polypeptides contain a deletion of amino acids 1-318 of the NTD of SEQ ID NO: 2. In embodiments, deletion of the NTD enhances protein expression of the CoV Spike (5) polypeptide. In embodiments, the CoV S polypeptides which have an NTD deletion have amino acid sequences represented by SEQ ID NOS: 46, 48, 49, 51, 52, and 54. In embodiments, the CoV S polypeptides which have an NTD deletion are encoded by an isolated nucleic acid sequence selected from the group consisting of SEQ ID NO: 47, SEQ ID NO: 50, and SEQ ID NO: 53.

In embodiments, the NTD may contain any combination of modifications shown in Table 1B. The modifications are shown with respect to SEQ ID NO:2, the mature S polypeptide sequence for reference.

TABLE 1B

| Position within SEQ ID NO: 1 | SEQ ID NO: 2 residue | SEQ ID NO: 121 or SEQ ID NO: 45 residue | Modifications |
|---|---|---|---|
| Modifications to NTD (SEQ ID NO: 118) | | | |
| 18 | 5 | 5 | mutation to phenylalanine |
| | | | mutation to tyrosine |
| | | | mutation to tryptophan |
| 19 | 6 | 6 | mutation to arginine |
| | | | mutation to lysine |
| | | | mutation to histidine |
| 20 | 7 | 7 | mutation to asparagine |
| | | | mutation to glutamine |
| | | | mutation to isoleucine |
| | | | mutation to valine |
| 26 | 13 | 13 | mutation to serine |
| | | | mutation to threonine |
| 64 | 51 | 51 | mutation to histidine |
| | | | mutation to lysine |
| | | | mutation to arginine |
| 66 | 53 | 53 | mutation to tryptophan |
| | | | mutation to tyrosine |
| | | | mutation to phenylalanine |
| 69 | 56 | 56 | Deletion of amino acid |
| 70 | 57 | 57 | Deletion of amino acid |
| | | | Mutation to phenylalanine |
| | | | Mutation to tyrosine |
| | | | Mutation to tryptophan |
| 75 | 62 | 62 | Mutation to valine |
| | | | Mutation to leucine |
| | | | Mutation to isoleucine |
| 76 | 63 | 63 | Mutation to isoleucine |
| | | | Mutation to valine |
| | | | Mutation to leucine |
| 80 | 67 | 67 | mutation to alanine |
| | | | mutation to glycine |
| 95 | 82 | 82 | mutation to beta branched amino acid |
| | | | mutation to isoleucine |
| | | | mutation to valine |
| 138 | 125 | 125 | mutation to tyrosine |
| | | | mutation to phenylalanine |
| | | | mutation to tryptophan |
| 142 | 129 | 129 | mutation to aspartic acid |
| | | | mutation to glutamic acid |
| 144 | 131 | 131 | Deletion of amino acid |
| | | | Mutation to serine |
| 145 | 132 | 132 | Deletion of amino acid |
| | | | Mutation to histidine |
| | | | Mutation to asparagine |
| | | | Mutation to glutamine |
| | | | insertion of 1, 2, 3, or 4 amino acids after this position |
| 146 | 133 | 133 | Mutation to aromatic amino acid |
| | | | Mutation to tyrosine |
| | | | Mutation to phenylalanine |
| | | | Mutation to tryptophan |
| 152 | 139 | 139 | mutation to cysteine |
| | | | mutation to methionine |
| | | | mutation to serine |
| | | | mutation to threonine |
| | | | mutation to arginine |
| 156 | 143 | 143 | mutation to glycine |
| | | | mutation to alanine |
| 157 | 144 | 144 | deletion of amino acid |
| 158 | 145 | 145 | deletion of amino acid |
| 190 | 177 | 177 | mutation to serine |
| | | | mutation to threonine |
| | | | mutation to cysteine |
| 213 | 200 | 200 | mutation to valine |
| | | | mutation to leucine |
| | | | mutation to isoleucine |
| | | | mutation to beta branched amino acid |
| 214 | 201 | 201 | mutation to arginine |
| | | | mutation to lysine |
| | | | mutation to histidine |
| 215 | 202 | 202 | mutation to glycine |
| | | | mutation to alanine |
| 222 | 209 | 209 | mutation to valine |
| | | | mutation to leucine |
| | | | mutation to isoleucine |
| 242 | 229 | 229 | mutation to histidine |
| | | | mutation to lysine |
| | | | mutation to arginine |
| 241-244 | 228-231 | 228-231 | deletion of 1, 2, 3, or 4 amino acids |
| 246 | 233 | 233 | mutation to beta-branched amino acid |
| | | | mutation to isoleucine |
| | | | mutation to valine |
| | | | mutation to threonine |
| | | | mutation to asparagine |
| 247 | 234 | 234 | deletion of amino acid |
| 248 | 235 | 235 | deletion of amino acid |
| 249 | 236 | 236 | deletion of amino acid |
| 250 | 237 | 237 | deletion of amino acid |
| 251 | 238 | 238 | deletion of amino acid |
| 252 | 239 | 239 | deletion of amino acid |
| 253 | 240 | 240 | mutation to glycine |
| | | | deletion of amino acid |
| 258 | 245 | 245 | mutation to isoleucine |
| | | | mutation to valine |
| | | | mutation to leucine |
| | | | mutation to beta branched amino acid |

* amino acids 14-305 of SEQ ID NO: 1 and amino acids 1-292 of SEQ ID NO: 2

Modifications to S1 Subunit-RBD

In embodiments, the CoV S polypeptides contain one or more modifications to the RBD.

In embodiments, the RBD has an amino acid sequence of SEQ ID NO: 126, which corresponds to amino acids 331-527 of SEQ ID NO: 1 or amino acids 318-514 of SEQ ID NO: 2.

The amino acid sequence of the RBD (SEQ ID NO: 126) is shown below:

```
NITNLCPFGEVFNATRFASVYAWNRKRISNCVADYSVLYNSASFSTFKC

YGVSPTKLNDLCFTNVYADSFVIRGDEVRQIAPGQTGKIADYNYKLPDD

FTGCVIAWNSNNLDSKVGGNYNYLYRLFRKSNLKPFERDISTEIYQAGS

TPCNGVEGFNCYFPLQSYGFQPTNGVGYQPYRVVVLSFELLHAPATVCG

P
```

Underlined regions of SEQ ID NO: 126 represent amino acids within the RBD subunit that may be modified.

In embodiments, the RBD has an amino acid sequence of SEQ ID NO: 116, which corresponds to amino acids 335-530 of SEQ ID NO: 1 or amino acids 322-517 of SEQ ID NO: 2.

The amino acid sequence of the RBD (SEQ ID NO: 116) is shown below.

```
LCPFGEVFNATRFASVYAWNRKRISNCVADYSVLYNSASFSTFKCYGVS

PTKLNDLCFTNVYADSFVIRGDEVRQIAPGQTGKIADYNYKLPDDFTGC

VIAWNSNNLDSKVGGNYNYLYRLFRKSNLKPFERDISTEIYQAGSTPCN

GVEGFNCYFPLQSYGFQPTNGVGYQPYRVVVLSFELLHAPATVCGPKKS
```

In embodiments, an RBD as provided herein may be extended at the N-terminus or C-terminus by up to 1 amino acid, up to 5 amino acids, up to 10 amino acids, up to 15 amino acids, up to 20 amino acids, up to 25 amino acids, or up to 30 amino acids.

In embodiments, the CoV S polypeptides described herein comprise a RBD with at least 95%, at least 96%, at least 97%, at least 98%, at least 99%, or at least 99.5%, identity to the RBD of SEQ ID NO: 1 or SEQ ID NO: 2. The RBD may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the RBD of SEQ ID NO: 1 or SEQ ID NO: 2. The RBD may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the RBD of SEQ ID NO: 1 or SEQ ID NO: 2.

In embodiments, the CoV S polypeptide has at least one, at least two, at least three, at least four, at least four, at least 5, at least 6, at least 7, at least 8, at least 9, at least 10, at least 11, at least 12, at least 13, at least 14, at least 15, at least 16, at least 17, at least 18, at least 19, or at least 20 mutations in the RBD. In embodiments, the RBD may contain any combination of modifications as shown in Table 1C.

TABLE 1C

| Modifications to RBD (SEQ ID NO: 126) | | | |
|---|---|---|---|
| Position within SEQ ID NO: 1 | Position within SEQ ID NO: 2 | Position within SEQ ID NO: 126 | Potential Modifications |
| 346 | 333 | 16 | mutation to lysine |
| | | | mutation to arginine |
| | | | mutation to histidine |
| 417 | 404 | 87 | mutation to asparagine |
| | | | mutation to threonine |
| | | | mutation to isoleucine |
| | | | mutation to valine |
| | | | mutation to serine |
| | | | mutation to glutamine |
| | | | mutation to beta-branched amino acid |
| 432 | 419 | 102 | mutation to lysine |
| | | | mutation to arginine |
| | | | mutation to histidine |
| 439 | 426 | 109 | mutation to lysine |
| | | | mutation to arginine |
| | | | mutation to histidine |
| 452 | 439 | 122 | mutation to arginine |
| | | | mutation to lysine |
| | | | mutation to histidine |
| | | | mutation to glutamine |
| | | | mutation to asparagine |
| 453 | 440 | 123 | mutation to phenylalanine |
| | | | mutation to tryptophan |
| 477 | 464 | 147 | mutation to asparagine |
| | | | mutation to glutamine |
| 478 | 465 | 148 | mutation to lysine |
| | | | mutation to arginine |
| | | | mutation to histidine |
| 484 | 471 | 154 | mutation to lysine |
| | | | mutation to arginine |
| | | | mutation to histidine |
| | | | mutation to glutamine |
| | | | mutation to asparagine |
| 490 | 477 | 160 | mutation to serine |
| | | | mutation to threonine |

TABLE 1C-continued

| Modifications to RBD (SEQ ID NO: 126) | | | |
|---|---|---|---|
| Position within SEQ ID NO: 1 | Position within SEQ ID NO: 2 | Position within SEQ ID NO: 126 | Potential Modifications |
| 494 | 481 | 164 | mutation to proline |
| 501 | 488 | 171 | mutation to tyrosine |
| | | | mutation to phenylalanine |
| | | | mutation to tryptophan |

* amino acids 331-527 of SEQ ID NO: 1 and amnio acids 318-514 of SEQ ID NO: 2

Modifications to SD1/2

In embodiments, the CoV S polypeptides contain one or more modifications to the SD1/2 having an amino acid sequence of SEQ ID NO: 122, which corresponds to amino acids 542-681 of SEQ ID NO: 1 or amino acids 529-668 of SEQ ID NO: 2.

The amino acid sequence of the SD1/2 (SEQ ID NO: 122) is shown below.

```
NFNGLTGTGVLTESNKKFLPFQQFGRDIADTTDAVRDPQTLEILDITPC

SFGGVSVITPGTNTSNQVAVLYQDVNCTEVPVAIHADQLTPTWRVYSTG

SNVFQTRAGCLIGAEHVNNSYECDIPIGAGICASYQTQTNSP
```

In embodiments, the CoV S polypeptides described herein comprise a SD1/2 with at least 95%, at least 96%, at least 97%, at least 98%, at least 99%, or at least 99.5%, identity to the SD1/2 of SEQ ID NO: 1 or SEQ ID NO: 2. The SD1/2 may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the SD1/2 of SEQ ID NO: 1 or SEQ ID NO: 2. The SD1/2 may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the SD1/2 of SEQ ID NO: 1 or SEQ ID NO: 2.

In embodiments, the CoV S polypeptide has at least one, at least two, at least three, at least four, at least four, at least 5, at least 6, at least 7, at least 8, at least 9, at least 10, at least 11, at least 12, at least 13, at least 14, at least 15, at least 16, at least 17, at least 18, at least 19, or at least 20 mutations in the SD1/2. In embodiments, the SD1/2 may contain any combination of modifications as shown in Table 1D.

TABLE 1D

| Modifications to SD1/2 (SEQ ID NO: 122) | | | |
|---|---|---|---|
| Position within SEQ ID NO: 1 | Position within SEQ ID NO: 2 | Position within SEQ ID NO: 122 | Potential Modifications |
| 570 | 557 | 29 | Mutation to aspartic acid |
| | | | Mutation to glutamic acid |
| 613 | 600 | 600 | Mutation to histidine |
| | | | Mutation to lysine |
| | | | Mutation to arginine |

TABLE 1D-continued

| Modifications to SD1/2 (SEQ ID NO: 122) | | | |
|---|---|---|---|
| Position within SEQ ID NO: 1 | Position within SEQ ID NO: 2 | Position within SEQ ID NO: 122 | Potential Modifications |
| 614 | 601 | 73 | Mutation to glycine<br>Mutation to alanine |
| 655 | 642 | 114 | Mutation to tyrosine<br>Mutation to phenylalanine<br>Mutation to tryptophan |
| 677 | 664 | 664 | Mutation to histidine |
| 681 | 668 | 140 | Mutation to histidine<br>Mutation to lysine<br>Mutation to arginine |

* amino acids 542-681 of SEQ ID NO: 1 or amino acids 529-668 of SEQ ID NO: 2

Modifications to Furin Cleavage Site

In embodiments, the CoV S polypeptides contain a furin site (RRAR), which corresponds to amino acids 682-685 of SEQ ID NO: 1 or amino acids 669-672 of SEQ ID NO: 2, that is inactivated by one or more mutations. Inactivation of the furin cleavage site prevents furin from cleaving the CoV S polypeptide. In embodiments, the CoV S polypeptides described herein which contain an inactivated furin cleavage site are expressed as a single chain.

In embodiments, one or more of the amino acids comprising the native furin cleavage site is mutated to any natural amino acid. In embodiments, the amino acids are L-amino acids. Non-limiting examples of amino acids include alanine, arginine, glycine, asparagine, aspartic acid, cysteine, glutamine, glutamic acid, serine, threonine, histidine, lysine, methionine, proline, valine, isoleucine, leucine, tyrosine, tryptophan, and phenylalanine.

In embodiments, one or more of the amino acids comprising the native furin cleavage site is mutated to glutamine. In embodiments, 1, 2, 3, or 4 amino acids may be mutated to glutamine. In embodiments, one of the arginines comprising the native furin cleavage site is mutated to glutamine. In embodiments, two of the arginines comprising the native furin cleavage site are mutated to glutamine. In embodiments, three of the arginines comprising the native furin cleavage site are mutated to glutamine.

In embodiments, one or more of the amino acids comprising the native furin cleavage site, is mutated to alanine. In embodiments, 1, 2, 3, or 4 amino acids may be mutated to alanine. embodiments, one of the arginines comprising the native furin cleavage site is mutated to alanine. In embodiments, two of the arginines comprising the native furin cleavage site are mutated to alanine. In embodiments, three of the arginines comprising the native furin cleavage site are mutated to alanine.

In embodiments, one or more of the amino acids comprising the native furin cleavage site is mutated to glycine. In embodiments, 1, 2, 3, or 4 amino acids may be mutated to glycine. In embodiments, one of the arginines of the native furin cleavage site is mutated to glycine. In embodiments, two of the arginines comprising the native furin cleavage site are mutated to glycine. In embodiments, three of the arginines comprising the native furin cleavage site are mutated to glycine.

In embodiments, one or more of the amino acids comprising the native furin cleavage site, is mutated to asparagine. For example 1, 2, 3, or 4 amino acids may be mutated to asparagine. In embodiments, one of the arginines comprising the native furin cleavage site is mutated to asparagine. In embodiments, two of the arginines comprising the native furin cleavage site are mutated to asparagine. In embodiments, three of the arginines comprising the native furin cleavage site are mutated to asparagine.

Non-limiting examples of the amino acid sequences of the inactivated furin sites contained within the CoV S polypeptides are found in Table IE.

TABLE IE

| Amino Acid Sequence of Furin Cleavage Site | Active or Inactive Furin Cleavage Site |
|---|---|
| RRAR (SEQ ID NO: 6) | Active |
| QQAQ (SEQ ID NO: 7) | Inactive |
| QRAR (SEQ ID NO: 8) | Inactive |
| RQAR (SEQ ID NO: 9) | Inactive |
| RRAQ (SEQ ID NO: 10) | Inactive |
| QQAR (SEQ ID NO: 11) | Inactive |
| RQAQ (SEQ ID NO: 12) | Inactive |
| QRAQ (SEQ ID NO: 13) | Inactive |
| NNAN (SEQ ID NO: 14) | Inactive |
| NRAR (SEQ ID NO: 15) | Inactive |
| RNAR (SEQ ID NO: 16) | Inactive |
| RRAN (SEQ ID NO: 17) | Inactive |
| NNAR (SEQ ID NO: 18) | Inactive |
| RNAN (SEQ ID NO: 19) | Inactive |
| NRAN (SEQ ID NO: 20) | Inactive |
| AAAA (SEQ ID NO: 21) | Inactive |
| ARAR (SEQ ID NO: 22) | Inactive |
| RAAR (SEQ ID NO: 23) | Inactive |
| RRAA (SEQ ID NO: 24) | Inactive |
| AAAR (SEQ ID NO: 25) | Inactive |
| RAAA (SEQ ID NO: 26) | Inactive |
| ARAA (SEQ ID NO: 27) | Inactive |
| GGAG (SEQ ID NO: 28) | Inactive |
| GRAR (SEQ ID NO: 29) | Inactive |
| RGAR (SEQ ID NO: 30) | Inactive |
| RRAG (SEQ ID NO: 31) | Inactive |
| GGAR (SEQ ID NO: 32) | Inactive |
| RGAG (SEQ ID NO: 33) | Inactive |
| GRAG (SEQ ID NO: 34) | Inactive |
| GSAS (SEQ ID NO: 97) | Inactive |
| GSGA (SEQ ID NO: 111) | Inactive |

In embodiments, in lieu of an active furin cleavage site (SEQ ID NO: 6) the CoV S polypeptides described herein contain an inactivated furin cleavage site. In embodiments, the amino acid sequence of the inactivated furin cleavage site is represented by any one of SEQ ID NO: 7-34 or SEQ ID NO: 97. In embodiments, the amino acid sequence of the inactivated furin cleavage site is QQAQ (SEQ ID NO: 7). In embodiments, the amino acid sequence of the inactivated furin cleavage site is GSAS (SEQ ID NO: 97). In embodiments, the amino acid sequence of the inactivated furin cleavage site is GSGA (SEQ ID NO: 111). In embodiments, the amino acid sequence of the inactivated furin cleavage site is GG, GGG (SEQ ID NO: 127), GGGG (SEQ ID NO: 128), or GGGGG (SEQ ID NO: 129).

Modifications to S2 Subunit

In embodiments, the CoV S polypeptides contain one or more modifications to the S2 subunit having an amino acid sequence of SEQ ID NO: 120, which corresponds to amino acids 686-1273 of SEQ ID NO: 1 or amino acids 673-1260 of SEQ ID NO: 2.

The amino acid sequence of the S2 subunit (SEQ ID NO: 120) is shown below.

```
SVASQSHIAYTMSLGAENSVAYSNNSIAIPTNFTISVTTEILPVSMTKT

SVDCTMYICGDSTECSNLLLQYGSFCTQLNRALTGIAVEQDKNTQEVFA

QVKQIYKTPPIKDFGGFNFSQILPDPSKPSKRSFIEDLLFNKVTLADAG

FIKQYGDCLGDIAARDLICAQKFNGLTVLPPLLTDEMIAQYTSALLAGT

ITSGWTFGAGAALQIPFAMQMAYRFNGIGVTQNVLYENQKLIANQFNSA

IGKIQDSLSSIASALGKLQDVVNQNAQALNTLVKQLSSNFGAISSVLND

ILSRLDKVEAEVQIDRLITGRLQSLQTYVTQQLIRAAEIRASANLAATK

MSECVLGQSKRVDFCGKGYHLMSFPQSAPHGVVFLHVTYVPAQEKNFTT

APAICHDGKAHFPREGVFVSNGTHWFVTQRNFYEPQIITTDNTFVSGNC

DVVIGIVNNTVYDPLQPELDSFKEELDKYFKNHTSPDVDLGDISGINAS

VVNIQKEIDRLNEVAKNLNESLIDLQELGKYEQYIKWPWYIWLGFIAGL

IAIVMVTIMLCCMISCCSCLKGCCSCGSCCKFDEDDSEPVLKGYKLHYT
```

In embodiments, the CoV S polypeptides described herein comprise an S2 subunit with at least 95%, at least 96%4, at least 97%, at least 98%, at least 99.5%, or at least 99.5%, identity to the S2 subunit of SEQ ID NO: 1 or SEQ ID NO: 2. The S2 subunit may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the S2 subunit of SEQ ID NO: 1 or SEQ ID NO: 2. The S2 subunit may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 aminoacids, between about 18 and 23 amino acids, between about 20 and 25 amino acids, between about 22 and about 27 amino acids, or between about 25 and 30 amino acids as compared to the S2 subunit of SEQ ID NO: 1 or SEQ ID NO: 2.

In embodiments, the S2 subunit may contain any combination of modifications as shown in Table 1F.

TABLE 1F

| Modifications to S2 (SEQ ID NO: 120) | | | |
|---|---|---|---|
| Position within SEQ ID NO: 1 | Position within SEQ ID NO: 2 | Position within SEQ ID NO: 120 | Possible Modifications |
| 689-698 | 676-685 | 4-13 | Deletion of up to about 1, up to about 2, up to about 3, up to about 4, up to about 5, up to about 6, up to about 7, up to about 8, up to about 9, or up to about 10 amino acids |
| 701 | 688 | 16 | Mutation to beta-branched amino acid<br>Mutation to valine<br>Mutation to isoleucine<br>Mutation to threonine |
| 715-724 | 702-711 | 30-39 | Deletion of up to about 1, up to about 2, up to about 3, up to about 4, up to about 5, up to about 6, up to about 7, up to about 8, up to about 9, or up to about 10 amino acids |
| 716 | 703 | 31 | Mutation to beta-branched amino acid<br>Mutation to valine<br>Mutation to isoleucine |
| 788-806 | 775-793 | 103-121 | Deletion of up to about 1, up to about 2, up to about 3, up to about 4, up to about 5, up to about 6, up to about 7, up to about 8, up to about 9, up to about 10, up to about 11, up to about 12, up to about 13, up to about 14, up to about 15, up to about 16, up to about 17, up to about 18, or up to about 19 amino acids |
| 819-828 | 806-815 | 134-143 | Deletion of up to about 1, up to about 2, up to about 3, up to about 4, up to about 5, up to about 6, up to about 7, up to about 8, up to about 9, or up to about 10 amino acids |
| 859 | 846 | 174 | Mutation to asparagine<br>Mutation to glutamine |
| 888 | 875 | 203 | Mutation to leucine<br>Mutation to isoleucine<br>Mutation to valine |
| 950 | 937 | 265 | Mutation to asparagine<br>Mutation to glutamine |
| 982 | 969 | 297 | Mutation to alanine<br>Mutation to glycine<br>Mutation to threonine |
| 986 | 973 | 301 | Mutation to proline<br>Mutation to glycine |
| 987 | 974 | 302 | Mutation to proline<br>Mutation to glycine |
| 1027 | 1014 | 342 | Mutation to isoleucine<br>Mutation to valine<br>Mutation to serine |
| 1071 | 1058 | 386 | Mutation to histidine<br>Mutation to arginine<br>Mutation to lysine |
| 1118 | 1105 | 433 | Mutation to histidine<br>Mutation to lysine<br>Mutation to arginine<br>Mutation to asparagine<br>Mutation to glutamine |
| 1176 | 1163 | 491 | Mutation to phenylalanine<br>Mutation to tyrosine<br>Mutation to tryptophan |
| 1214-1237 | 1201-1224 | 1-24 | Deletion of one or more amino acids of TM |
| 1238-1273 | 1225-1260 | 1-36 | Deletion of one or more amino acids of (CT) |

* amino acids 686-1273 of SEQ ID NO: 1 and amino acids 673-1260 of SEQ ID NO: 2

In embodiments, the CoV S polypeptides contain a deletion, corresponding to one or more deletions within amino acids 676-685 of the native CoV Spike (S) polypeptide (SEQ ID NO: 2). In embodiments, 1, 2, 3, 4, 5, 6, 7, 8, 9, or 10 amino acids of amino acids 676-685 of the native CoV Spike (S) polypeptide (SEQ ID NO:2) are deleted. In embodiments, the deletions of amino acids within amino acids 676-685 are consecutive e.g. amino acids 676 and 677 are deleted or amino acids 680 and 681 are deleted. In embodiments, the deletions of amino acids within amino acids 676-685 are non-consecutive e.g. amino acids 676 and 680 are deleted or amino acids 677 and 682 are deleted. In embodiments, CoV S polypeptides containing a deletion, corresponding to one or more deletions within amino acids 676-685, have an amino acid sequence selected from the group consisting of SEQ ID NO: 62 and SEQ ID NO: 63.

In embodiments, the CoV S polypeptides contain a deletion, corresponding to one or more deletions within amino acids 702-711 of the native CoV Spike (5) polypeptide (SEQ ID NO: 2). In embodiments, 1, 2, 3, 4, 5, 6, 7, 8, 9, or 10 amino acids of amino acids 702-711 of the native SARS-CoV-2 Spike (5) polypeptide (SEQ ID NO:2) are deleted. In embodiments, the one or more deletions of amino acids within amino acids 702-711 are consecutive e.g. amino acids 702 and 703 are deleted or amino acids 708 and 709 are deleted. In embodiments, the deletions of amino acids within amino acids 702-711 are non-consecutive e.g. amino acids 702 and 704 are deleted or amino acids 707 and 710 are deleted. In embodiments, the CoV S polypeptides containing a deletion, corresponding to one or more deletions within amino acids 702-711, have an amino acid sequence selected from the group consisting of SEQ ID NO: 64 and SEQ ID NO: 65.

In embodiments, the CoV S polypeptides contain a deletion, corresponding to one or more deletions within amino acids 775-793 of the native CoV S polypeptide (SEQ ID NO: 2). In embodiments, up to about 1, 2, 3, 4, 5, 6, 7, 8, 9, 10, 11, 12, 13, 14, 15, 16, 17, 18, or 19 amino acids of amino acids 775-793 of the native SARS-CoV-2 Spike (S) polypeptide (SEQ ID NO:2) are deleted. In embodiments, the one or more deletions of amino acids within amino acids 775-793 are consecutive e.g. amino acids 776 and 777 are deleted or amino acids 780 and 781 are deleted. In embodiments, the deletions of amino acids within amino acids 775-793 are non-consecutive e.g. amino acids 775 and 790 are deleted or amino acids 777 and 781 are deleted.

In embodiments, the CoV S polypeptides contain a deletion of the fusion peptide (SEQ ID NO: 104), which corresponds to amino acids 806-815 of SEQ ID NO: 2. In embodiments, 1, 2, 3, 4, 5, 6, 7, 8, 9, or 10 amino acids of the fusion peptide of the CoV Spike (S) polypeptide (SEQ ID NO:2) are deleted. In embodiments, the deletions of amino acids within the fusion peptide are consecutive e.g. amino acids 806 and 807 are deleted or amino acids 809 and 810 are deleted. In embodiments, the deletions of amino acids within the fusion peptide are non-consecutive e.g. amino acids 806 and 808 are deleted or amino acids 810 and 813 are deleted. In embodiments, the CoV S polypeptides containing a deletion, corresponding to one or more amino acids of the fusion peptide, have an amino acid sequence selected from SEQ ID NOS: 66, 77, and 105-108.

In embodiments, the CoV S polypeptides contain a mutation at Lys-973 of the native CoV Spike (S) polypeptide (SEQ ID NO: 2). In embodiments, Lys-973 is mutated to any natural amino acid. In embodiments, Lys-973 is mutated to proline. In embodiments, Lys-973 is mutated to glycine. In embodiments, the CoV S polypeptides containing a mutation at amino acid 973 are selected from the group consisting of SEQ ID NO: 84-89, 105-106, and 109-110.

In embodiments, the CoV S polypeptides contain a mutation at Val-974 of the native CoV Spike (S) polypeptide (SEQ ID NO: 2). In embodiments, Val-974 is mutated to any natural amino acid. In embodiments, Val-974 is mutated to proline. In embodiments, Val-974 is mutated to glycine. In embodiments, the CoV S polypeptides containing a mutation at amino acid 974 are selected from the group consisting of SEQ ID NO: 84-89, 105-106, and 109-110.

In embodiments, the CoV S polypeptides contain a mutation at Lys-973 and Val-974 of the native CoV Spike (S) polypeptide (SEQ ID NO: 2). In embodiments, Lys-973 and Val-974 are mutated to any natural amino acid. In embodiments, Lys-973 and Val-974 are mutated to proline. In embodiments, the CoV S polypeptides containing a mutation at amino acids 973 and 974 are selected from SEQ ID NOS: 84-89, 105-106, and 109-110.

Modifications to S2 Subunit-HR1 Domain

In embodiments, the CoV S polypeptides contain one or more modifications to the HR1 domain having an amino acid sequence of SEQ ID NO: 119, which corresponds to amino acids 912-984 of SEQ ID NO: 1 or amino acids 889-971 of SEQ ID NO: 2.

The amino acid sequence of the HR1 domain (SEQ ID NO: 119) is shown below.

```
MAYRFNGIGVTQNVLYENQKLIANQFNSAIGKIQDSLSSTASALGKLQD

VVNQNAQALNTLVKQLSSNFGAISSVLNDILSRL
```

In embodiments, the CoV S polypeptides described herein comprise an HR1 domain with at least 95%, at least 96%, at least 97%, at least 98%, at least 99%, or at least 99.5%, identity to the HR1 domain of SEQ ID NO: 1 or SEQ ID NO: 2. The HR1 domain may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the HR1 domain of SEQ ID NO: 1 or SEQ ID NO: 2. The HR1 domain may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the HR1 domain of SEQ ID NO: 1 or SEQ ID NO: 2.

In embodiments, the HR1 domain may contain any combination of modifications as shown in Table 1G.

TABLE 1G

| Modifications to HR1 (SEQ ID NO: 119) | | | |
|---|---|---|---|
| Position within SEQ ID NO: 1 | Position within SEQ ID NO: 2 | Position within SEQ ID NO: 119 | Possible Modifications |
| 982 | 969 | 81 | Mutation to alanine<br>Mutation to glycine<br>Mutation to threonine |

* amino acids 912-984 of SEQ ID NO: 1 and amino acids 889-971 of SEQ ID NO: 2)

Modfications to S2 Subunit-HR2 Domain

In embodiments, the CoV S polypeptides contain one or more modifications to the HR2 domain having an amino acid sequence of SEQ ID NO: 125, which corresponds to amino acids 1163-1213 of SEQ ID NO: 1 or amino acids 1150-1200 of SEQ ID NO: 2.

The amino acid sequence of the HR2 domain (SEQ ID NO: 125) is shown below.

DVDLGDISGINASVVNIQKEIDRLNEVAKNLNESLIDLQELGKYEQYIKW

P

In embodiments, the CoV S polypeptides described herein comprise an HR2 domain with at least 95%, at least 96%, at least 97%, at least 98%, at least 99%, or at least 99.5%, identity to the HR2 domain of SEQ ID NO: 1 or SEQ ID NO: 2. The HR2 domain may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the HR2 domain of SEQ ID NO: 1 or SEQ ID NO: 2. The HR2 domain may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the HR2 domain of SEQ ID NO: 1 or SEQ ID NO: 2.

Modifications to the TM Domain

In embodiments, the CoV S polypeptides contain one or more modifications to the TM domain having an amino acid sequence of SEQ ID NO: 123, which corresponds to amino acids 1214-1237 of SEQ ID NO: 1 or amino acids 1201-1224 of SEQ ID NO: 2.

The amino acid sequence of the TM domain (SEQ ID NO: 123) is shown below.

WYIWLGFIAGLIAIVMVTIMLCCM

In embodiments, the CoV S polypeptides described herein comprise a TM domain with at least 95%, at least 96%, at least 97%, at least 98%, at least 99%, or at least 99.5%, identity to the TM domain of SEQ ID NO: 1 or SEQ ID NO: 2. The TM domain may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the TM domain of SEQ ID NO: 1 or SEQ ID NO: 2. The TM domain may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the TM domain of SEQ ID NO: 1 or SEQ ID NO: 2.

In embodiments, the CoV S polypeptides described herein lack the entire TM domain. In embodiments, the CoV S polypeptides comprise the TM domain.

Modifications to the CT

In embodiments, the CoV S polypeptides contain one or more modifications to the CT having an amino acid sequence of SEQ ID NO: 124, which corresponds to amino acids 1238-1273 of SEQ ID NO: 1 or amino acids 1225-1260 of SEQ ID NO: 2.

The amino acid sequence of the CT (SEQ ID NO: 124) is shown below:

TSCCSCLKGCCSCGSCCKFDEDDSEPVLKGVKLHYT

In embodiments, the CoV S polypeptides described herein comprise a CT with at least 95%, at least 96%, at least 97%, at least 98%, at least 99%, or at least 99.5%, identity to the CT of SEQ ID NO: 1 or SEQ ID NO: 2. The CT may have a deletion, an insertion, or mutation of up to about 1, up to about 2, up to about 3, up to about 4, up to about 5, up to about 10, up to about 15, up to about 20, up to about 25, or up to about 30 amino acids compared to the amino acid sequence of the CT of SEQ ID NO: 1 or SEQ ID NO: 2. The CT may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, or between about 25 and 30 amino acids as compared to the CT of SEQ ID NO: 1 or SEQ ID NO: 2.

In embodiments, the CoV S polypeptides described herein lack a CT. In embodiments, the CoV S polypeptides comprise the CT.

In embodiments, the CoV S polypeptides comprise a TM and a CT. In embodiments, the CoV Spike (S) polypeptides contain a deletion of one or more amino acids from the transmembrane and cytoplasmic tail (TMCT) (corresponding to amino acids 1201-1260). The amino acid sequence of the TMCT is represented by SEQ ID NO: 39. In embodiments, the CoV S polypeptides which have a deletion of one or more residues of the TMCT have enhanced protein expression. In embodiments, the CoV Spike (S) polypeptides which have one or more deletions from the TMCT have an amino acid sequence selected from the group consisting of SEQ ID NO: 40, 41, 42, 52, 54, 59, 61, 88, and 89. In embodiments, the CoV S polypeptides which have one or more deletions from the TM-CD are encoded by an isolated nucleic acid sequence selected from the group consisting of SEQ ID NO: 39, 43, 53, and 60.

Exemplary Non-Naturally Occurring CoV S Polypeptides or Nanoparticles

In embodiments, the CoV S polypeptides contain a deletion of amino acids 56 and 57 of the native CoV Spike (S) polypeptide (SEQ ID NO: 2).

In embodiments, the CoV S polypeptides contain deletions of amino acids 131 and 132 of the native CoV Spike (S) polypeptide (SEQ ID NO: 2).

In embodiments, the CoV S polypeptides contain a deletion of amino acids 56 and 131 of the native CoV Spike (S) polypeptide (SEQ ID NO: 2). In embodiments, the CoV S polypeptides contain a deletion of amino acids 57 and 131 of the native CoV Spike (S) polypeptide (SEQ ID NO: 2).

In embodiments, the CoV S polypeptides contain a deletion of amino acids 56, 57, and 131 of the native CoV Spike (S) polypeptide (SEQ ID NO: 2).

In embodiments, the CoV S polypeptides contain a deletion of amino acids 56 and 132 of the native CoV Spike (S) polypeptide (SEQ ID NO: 2).

In embodiments, the CoV S polypeptides contain a deletion of amino acids 57 and 132 of the native CoV Spike (S) polypeptide (SEQ ID NO: 2).

In embodiments, the CoV S polypeptides contain a deletion of amino acids 56, 57, and 132 of the native CoV Spike (S) polypeptide (SEQ ID NO: 2).

In embodiments, the CoV S polypeptides contain a deletion of amino acids 56, 57, 131, and 132 of the native CoV Spike (S) polypeptide (SEQ ID NO: 2).

In embodiments, the CoV S polypeptides contain mutations that stabilize the prefusion conformation of the CoV S polypeptide. In embodiments, the CoV S polypeptides contain proline or glycine substitutions which stabilize the prefusion conformation. This strategy has been utilized for to develop a prefusion stabilized MERS-CoV S protein as described in the following documents which are each incorporated by reference herein in their entirety: Proc Natl Acad Sci USA. 2017 Aug. 29; 114(35):E7348-E7357; Sci Rep. 2018 Oct. 24; 8(1):15701; U.S. Publication No. 2020/0061185; and PCT Application No. PCT/US2017/058370.

In embodiments, the CoV S polypeptides contain a mutation at Lys-973 and Val-974 and an inactivated furin cleavage site. In embodiments, the CoV S polypeptides contain mutations of Lys-973 and Val-974 to proline and an inactivated furin cleavage site, having the amino acid sequence of QQAQ (SEQ ID NO: 7) or GSAS (SEQ ID NO: 96).mAn exemplary CoV S polypeptide containing a mutation at Lys-973 and Val-974 and an inactivated furin cleavage site is depicted in FIG. 3. In embodiments, the CoV S polypeptides containing mutations of Lys-973 and Val-974 to proline and an inactivated furin cleavage site have an amino acid sequences of SEQ ID NOS: 86 or 87 and a nucleic acid sequence of SEQ ID NO: 96.

In embodiments, the CoV S polypeptides contain a mutation at Lys-973 and Val-974, an inactivated furin cleavage site, and a deletion of one or more amino acids of the fusion peptide. In embodiments, the CoV S polypeptides contain mutations of Lys-973 and Val-974 to proline, an inactivated furin cleavage site having the amino acid sequence of QQAQ (SEQ ID NO: 7) or GSA S (SEQ ID NO: 96), and deletion of one or more amino acids of the fusion peptide. In embodiments, the CoV S polypeptides containing mutations of Lys-973 and Val-974 to proline, an inactivated furin cleavage site, and deletion of one or more amino acids of the fusion peptide having an amino acid sequence of SEQ ID NO: 105 or 106. In embodiments, the CoV S polypeptide contains a mutation of Leu-5 to phenylalanine, mutation of Thr-7 to asparagine, mutation of Pro-13 to serine, mutation of Asp-125 to tyrosine, mutation of Arg-177 to serine, mutation of Lys-404 to threonine, mutation of Glu-471 to lysine, mutation of Asn-488 to tyrosine, mutation of His-642 to tyrosine, mutation of Thr-1014 to isoleucine, mutations of Lys-973 and Val-974 to proline, and an inactivated furin cleavage site having the amino acid sequence of QQAQ (SEQ ID NO: 7) or GSA S (SEQ ID NO: 96) relative to the native CoV Spike (S) polypeptide (SEQ ID NO: 2).

In embodiments, the CoV S polypeptide contains a mutation of Trp-139 to cysteine, mutation of Leu-439 to arginine, mutations of Lys-973 and Val-974 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 2). In embodiments, the CoV S polypeptide contains a mutation of Trp-152 to cysteine, mutation of Leu-452 to arginine, mutation of Ser-13 to isoleucine, mutations of Lys-986 and Val-987 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 1).

In embodiments, the CoV S polypeptide contains a mutation of Lys-404 to threonine or asparagine, mutation of Glu-471 to lysine, mutation of Asn-488 to tyrosine, mutation of Leu-5 to phenylalanine, mutation of Asp-67 to alanine, mutation of Asp-202 to glycine, deletion of one or more of amino acids 229-231, mutation of Arg-233 to isoleucine, mutations of Lys-973 and Val-974 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 2).

In embodiments, the CoV S polypeptide contains a mutation of Asn-488 to tyrosine, mutations of Lys-973 and Val-974 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 2). In embodiments, the CoV S polypeptide having a mutation of Asn-488 to tyrosine, mutations of Lys-973 and Val-974 to proline, and an inactivated furin cleavage site having the amino acid sequence of QQAQ (SEQ ID NO: 7) or GSAS (SEQ ID NO: 96) comprises an amino acid sequence of SEQ ID NO: 112.

In embodiments, the CoV S polypeptide contains a mutation of Asp-601 to glycine, a mutation of Asn-488 to tyrosine, mutations of Lys-973 and Val-974 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 2). In embodiments, the CoV S polypeptide having a mutation of Asn-488 to tyrosine, mutations of Lys-973 and Val-974 to proline, and an inactivated furin cleavage site having the amino acid sequence of QQAQ (SEQ ID NO: 7) or GSAS (SEQ ID NO: 96) comprises an amino acid sequence of SEQ ID NO: 113.

In embodiments, the CoV S polypeptide contains deletion of amino acids 56, 57, and 131, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of QQAQ (SEQ ID NO: 7), GSAS (SEQ ID NO: 96), or GG relative to the native CoV Spike (S) polypeptide (SEQ ID NO: 2). In embodiments, the CoV S polypeptide having deletion of amino acids 56, 57, and 131, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of QQAQ (SEQ ID NO: 7) or GSAS (SEQ ID NO: 96) comprises an amino acid sequence of SEQ ID NO: 114. In embodiments, the CoV S polypeptide having deletion of amino acids 56, 57, and 131, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of QQAQ (SEQ ID NO: 7) or GSAS (SEQ ID NO: 96) or GG comprises an amino acid sequence of SEQ ID NO: 136. In embodiments, the CoV S polypeptide having deletion of amino acids 56, 57, and 131, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of GG comprises an amino acid sequence of SEQ ID NO: 137 or SEQ ID NO: 138. In some embodiments, the CoV S polypeptide having an amino acid sequence of SEQ ID NO: 114 or SEQ ID NO: 136 is encoded by a nucleic acid having a nucleic acid sequence of SEQ ID NO: 135. In some embodiments, the CoV S polypeptide having an amino acid sequence of SEQ ID NO: 137 or SEQ ID NO: 138 is encoded by a nucleic acid having a sequence of SEQ ID NO: 139.

In embodiments, the CoV S polypeptide contains deletion of amino acids 56, 57, and 132, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of QQAQ (SEQ ID NO: 7) or GSAS (SEQ ID NO: 96 relative to the native CoV Spike (S) polypeptide (SEQ ID NO: 2). In embodiments, the CoV S polypeptide having a deletion of amino acids 56, 57, and 132, mutation of Asn-488 to tyrosine, a mutation of Ala-557 to aspartate, mutation of Asp-601 to glycine, mutation of Pro-668 to histidine, mutation of Thr-703 to isoleucine, mutation of Ser-969 to alanine, mutation of Asp-1105 to histidine, mutations of Lys-973 and Val-974 to proline, and an inactivated furin cleavage site having the amino acid sequence of QQAQ (SEQ ID NO: 7) or GSAS (SEQ ID NO: 96) comprises an amino acid sequence of SEQ ID NO: 114.

In embodiments, the CoV S polypeptide contains mutation of Asn-488 to tyrosine, mutation of Asp-67 to alanine, mutation of Leu-229 to histidine, mutation of Asp-202 to glycine, mutation of Lys-404 to asparagine, mutation of Glu-471 to lysine, mutation of Ala-688 to valine, mutation of Asp-601 to glycine, mutations of Lys-973 and Val-974 to proline, and an inactivated furin cleavage site having the amino acid sequence of QQAQ (SEQ ID NO: 7) or GSAS (SEQ ID NO: 96) relative to the native CoV Spike (S) polypeptide (SEQ ID NO: 2). In embodiments, the CoV S polypeptide having a mutation of Asn-488 to tyrosine, mutation of Asp-67 to alanine, mutation of Leu-229 to histidine, mutation of Asp-202 to glycine, mutation of Lys-404 to asparagine, mutation of Glu-471 to lysine, mutation of Ala-688 to valine, mutation of Asp-601 to glycine, mutations of Lys-973 and Val-974 to proline, and an inactivated furin cleavage site having the amino acid sequence of QQAQ (SEQ ID NO: 7) or GSAS (SEQ ID NO: 96) comprises an amino acid sequence of SEQ ID NO: 115.

In embodiments, the CoV S polypeptide contains one or more modifications selected from: K973P, V974P, an inactivated furin cleavage site, deletions of amino acid 56, deletion of amino acid 57, deletion of amino acid 131, N488Y, A557D, D601G, P668H, T703I , S969A, and D1105H, wherein the amino acids are numbered with respect to a CoV S polypeptide having an amino acid sequence of SEQ ID NO: 2. In embodiments, the inactivated furin cleavage site has the amino acid sequence of QQAQ (SEQ ID NO: 7). In embodiments, the inactivated furin cleavage site has the amino acid sequence of GG.

In embodiments, the CoV S polypeptide contains one or more modifications selected from: K973P, V974P, an inactivated furin cleavage site, D67A, D202G, L229H, K404N, E471K, N488Y, D601G, and A688V, wherein the amino acids are numbered with respect to a CoV S polypeptide having an amino acid sequence of SEQ ID NO: 2. In embodiments, the inactivated furin cleavage site has the amino acid sequence of QQAQ (SEQ ID NO: 7). In embodiments, the inactivated furin cleavage site has the amino acid sequence of GG.

In embodiments, the CoV S polypeptide contains one or more modifications selected from: K973P, V974P, an inactivated furin cleavage site, deletion of amino acids 229-231, D67A, D202G, K404N, E471K, N488Y, D601G, and A688V, wherein the amino acids are numbered with respect to a CoV S polypeptide having an amino acid sequence of SEQ ID NO: 2.

In embodiments, the CoV S polypeptide contains one or more modifications selected from: K973P, V974P, an inactivated furin cleavage site having the amino acid sequence of QQAQ (SEQ ID NO: 7), deletion of amino acids 229-231, L5F, D67A, D202G, K404N, E471K, N488Y, D601G, and A688V, wherein the amino acids are numbered with respect to a CoV S polypeptide having an amino acid sequence of SEQ ID NO: 2. In embodiments, the CoV S polypeptide having one or more modifications selected from K973P, V974P, an inactivated furin cleavage site having the amino acid sequence of QQAQ (SEQ ID NO: 7), deletion of amino acids 229-231, L5F, D67A, D202G, K404N, E471K, N488Y, D601G, and A688V, wherein the amino acids are numbered with respect to a CoV S polypeptide having an amino acid sequence of SEQ ID NO: 2 comprises the amino acid sequence of SEQ ID NO: 144. In embodiments, the CoV S polypeptide having the amino acid sequence of SEQ ID NO: 144 is encoded by a nucleic acid having a sequence of SEQ ID NO: 145.

In embodiments, the CoV S polypeptide contains one or more modifications selected from: K973P, V974P, an inactivated furin cleavage site having the amino acid sequence of GG, deletion of amino acids 229-231, L5F, D67A, D202G, K404N, E471K, N488Y, D601G, and A688V, wherein the amino acids are numbered with respect to a CoV S polypeptide having an amino acid sequence of SEQ ID NO: 2. In embodiments, the CoV S polypeptide having one or more modifications selected from K973P, V974P, an inactivated furin cleavage site having the amino acid sequence of GG, deletion of amino acids 229-231, L5F, D67A, D202G, K404N, E471K, N488Y, D601G, and A688V, wherein the amino acids are numbered with respect to a CoV S polypeptide having an amino acid sequence of SEQ ID NO: 2 comprises the amino acid sequence of SEQ ID NO: 144. In embodiments, the CoV S polypeptide having the amino acid sequence of SEQ ID NO: 144 is encoded by a nucleic acid having a sequence of SEQ ID NO: 145.

In embodiments, the CoV S polypeptide contains one or more modifications selected from: K973P, V974P, an inactivated furin cleavage site, L5F, T7N, P13S, D125Y, R177S, K404T, E471K, N488Y, D601G, H642Y, T1014I, and V1163F, wherein the amino acids are numbered with respect to a CoV S polypeptide having an amino acid sequence of SEQ ID NO: 2. In embodiments, the CoV S polypeptide containing one or more modifications selected from: K973P, V974P, an inactivated furin cleavage site, L5F, T7N, P13S, D125Y, R177S, K404T, E471K, N488Y, D601G, H642Y, T1014I , and V1163F, wherein the amino acids are numbered with respect to a CoV S polypeptide having an amino acid sequence of SEQ ID NO: 2, has an amino acid sequence of SEQ ID NO: 151. In embodiments, the CoV S polypeptide having an amino acid sequence of SEQ ID NO: 151 is encoded by a nucleic acid having a sequence of SEQ ID NO: 150.

In embodiments, the CoV S polypeptide contains one or more modifications selected from: K973P, V974P, an inactivated furin cleavage site, deletion of amino acids 229-231, $L5^F$, D67A, D202G, L229H, K404N, E471K, N488Y, D601G, and A688V, wherein the amino acids are numbered with respect to a CoV S polypeptide having an amino acid sequence of SEQ ID NO: 2.

In embodiments, the CoV S polypeptide contains one or more modifications selected from: K973P, V974P, an inactivated furin cleavage site, K404N, E471K, N488Y, L5F, D67A, D202G, L229H, D601G, A688V, and deletion of amino acids 229-231, wherein the amino acids are numbered with respect to a CoV S polypeptide having an amino acid sequence of SEQ ID NO: 2. In embodiments, the inactivated furin cleavage site has the amino acid sequence of QQAQ (SEQ ID NO: 7). In embodiments, the inactivated furin cleavage site has the amino acid sequence of GG In embodiments, the CoV S polypeptide contains one or more modifications selected from: K973P, V974P, an inactivated furin cleavage site, K404N, E471K, and N488K wherein the amino acids are numbered with respect to a CoV S polypeptide having an amino acid sequence of SEQ ID NO: 2. In embodiments, the CoV S polypeptide contains one or more modifications selected from: K973P, V974P, an inactivated furin cleavage site, K404N, E471K, and N488Y. In embodiments, the CoV S polypeptide is the RBD of the CoV S polypeptide having one or more modifications selected from K973P, V974P, an inactivated furin cleavage site, K404N, E471K, and N488K wherein the amino acids are numbered with respect to a CoV S polypeptide having an amino acid sequence of SEQ ID NO: 2. In embodiments, the CoV S polypeptide is the RBD of the CoV S polypeptide having one or more modifications selected from K973P, V974P, an inactivated furin cleavage site, K404N, E471K, and N488Y wherein the amino acids are numbered with respect to a CoV S polypeptide having an amino acid sequence of SEQ ID NO: 2.

In embodiments, the CoV S polypeptide contains one or more modifications selected from: K973P, V974P, an inactivated furin cleavage site having the amino acid sequence of GG, D601G, E404N, E471K, and N488Y. In embodiments, the CoV S polypeptide contains one or more modifications selected from: K973P, V974P, an inactivated furin cleavage site having the amino acid sequence of GG, and a D601G mutation, wherein the amino acids are numbered with respect to a CoV S polypeptide having an amino acid sequence of SEQ ID NO: 2. In embodiments, the CoV S polypeptide containing modifications selected from: K973P, V974P, an inactivated furin cleavage site having the amino acid sequence of GG, and a D601G mutation has an amino acid sequence of SEQ ID NO: 133.

In embodiments, the CoV S polypeptide contains one or more modifications selected from: K973P, V974P, an inactivated furin cleavage site, optionally wherein the inactivated furin cleavage site is QQAQ (SEQ ID NO: 7) or GG, K404N, E471K, N488K, D67A, D202G, L229H, D601G, and A688V, wherein the amino acids are numbered with respect to a CoV S polypeptide having an amino acid sequence of SEQ ID NO: 2. In embodiments, the CoV S polypeptide containing one or more modifications selected from: K973P, V974P, an inactivated furin cleavage site, optionally wherein the inactivated furin cleavage site is QQAQ (SEQ ID NO: 7) or GG, K404N, E471K, N488K, D67A, D202G, L229H, D601G, and A688V has an amino acid sequence of SEQ ID NO: 132 or SEQ ID NO: 141. In embodiments, the CoV S polypeptide having an amino acid sequence of SEQ ID NO: 132 is encoded by a nucleic acid having a nucleic acid sequence of SEQ ID NO: 131. In embodiments, the CoV S polypeptide having an amino acid sequence of SEQ ID NO: 132 is encoded by a nucleic acid having a nucleic acid sequence of SEQ ID NO: 142.

In embodiments, the CoV S polypeptide contains one or more modifications selected from: K973P, V974P, an inactivated furin cleavage site, W139C and L439R, wherein the amino acids are numbered with respect to a CoV S polypeptide having an amino acid sequence of SEQ ID NO: 2. In embodiments, the CoV S polypeptide comprising K973P, V974P, an inactivated furin cleavage site, W139C and L439R modifications is expressed with a signal peptide having an amino acid sequence of SEQ ID NO: 117 or SEQ ID NO: 5. In embodiments, the CoV S polypeptide comprises one or more modifications selected from: K973P, V974P, an inactivated furin cleavage site, D601G, W139C, and L439R, wherein the amino acids are numbered with respect to a CoV S polypeptide having an amino acid sequence of SEQ ID NO: 2. In embodiments, the CoV S polypeptide comprises K973P, V974P, an inactivated furin cleavage site, D601G, W139C, and L439R modifications and is expressed with a signal peptide having an amino acid sequence of SEQ ID NO: 117 or SEQ ID NO: 5.

In embodiments, the CoV S polypeptide comprises one or more modifications selected from: K973P, V974P, an inactivated furin cleavage site, D601G, L5F, D67A, D202G, deletions of amino acids 229-231, R233I, K404N, E471K, N488Y, and A688V, wherein the amino acids are numbered with respect to a CoV S polypeptide having an amino acid sequence of SEQ ID NO:

In embodiments, the CoV S polypeptide contains one or more modifications selected from: K973P, V974P, an inactivated furin cleavage site, optionally wherein the inactivated furin cleavage site is QQAQ (SEQ ID NO: 7), W139C, S481P, D601G, and L439R, wherein the amino acids are numbered with respect to a CoV S polypeptide having an amino acid sequence of SEQ ID NO: 2. In embodiments, the CoV S polypeptide contains one or more modifications selected from: K973P, V974P, an inactivated furin cleavage site, optionally wherein the inactivated furin cleavage site is QQAQ (SEQ ID NO: 7), W139C, D601G, and L439R, wherein the amino acids are numbered with respect to a CoV S polypeptide having an amino acid sequence of SEQ ID NO: 2. In embodiments, the CoV S polypeptide contains one or more modifications selected from: K973P, V974P, an inactivated furin cleavage site, optionally wherein the inactivated furin cleavage site is QQAQ (SEQ ID NO: 7), W139C, S481P, and D601G wherein the amino acids are numbered with respect to a CoV S polypeptide having an amino acid sequence of SEQ ID NO: 2. In embodiments, the CoV S polypeptide containing one or more modifications selected from: K973P, V974P, an inactivated furin cleavage site, optionally wherein the inactivated furin cleavage site is QQAQ (SEQ ID NO: 7), W139C, S481P, D601G, and L439R has the amino acid sequence of SEQ ID NO: 153. In embodiments, the CoV S polypeptide having the amino acid sequence of SEQ ID NO: 153 comprises a signal peptide having an amino acid sequence of SEQ ID NO: 117. In embodiments, the CoV S polypeptide having the amino acid sequence of SEQ ID NO: 153 comprises a signal peptide having an amino acid sequence of SEQ ID NO: 5.

In embodiments, the CoV S polypeptide contains one or more modifications selected from: K973P, V974P, an inactivated furin cleavage site, optionally wherein the inactivated furin cleavage site is QQAQ (SEQ ID NO: 7), T82I, D240G, E471K, D601G, and A688V, wherein the amino acids are numbered with respect to a CoV S polypeptide having an amino acid sequence of SEQ ID NO: 2. In embodiments, the CoV S polypeptide containing one or more modifications selected from: K973P, V974P, an inactivated furin cleavage site, optionally wherein the inactivated furin cleavage site is QQAQ (SEQ ID NO: 7), T82I, D240G, E471K, D601G, and A688V, wherein the amino acids are numbered with respect to a CoV S polypeptide having an amino acid sequence of SEQ ID NO: 2, has an amino acid sequence of SEQ ID NO: 156. In embodiments, the CoV S polypeptide containing one or more modifications selected from: K973P, V974P, an inactivated furin cleavage site, optionally wherein the inactivated furin cleavage site is QQAQ (SEQ ID NO: 7), T82I, D240G, E471K, D601G, and A688V, wherein the amino acids are numbered with respect to a CoV S polypeptide having an amino acid sequence of SEQ ID NO: 2, comprises a signal peptide having an amino acid sequence of SEQ ID NO: 154 or SEQ ID NO: 5.

In embodiments, the CoV S polypeptide contains one or more modifications selected from: K973P, V974P, an inactivated furin cleavage site, optionally wherein the inactivated furin cleavage site is QQAQ (SEQ ID NO: 7), T82I , D240G, S464N, D601G, and A688V, wherein the amino acids are numbered with respect to a CoV S polypeptide having an amino acid sequence of SEQ ID NO: 2. In embodiments, the CoV S polypeptide containing one or more modifications selected from: K973P, V974P, an inactivated furin cleavage site, optionally wherein the inactivated furin cleavage site is QQAQ (SEQ ID NO: 7), T82I , D240G, S464N, D601G, and A688V, wherein the amino acids are numbered with respect to a CoV S polypeptide having an amino acid sequence of SEQ ID NO: 2, has an amino acid sequence of SEQ ID NO: 158. In embodiments, the CoV S polypeptide containing one or more modifications selected from: K973P, V974P, an inactivated furin cleavage site, optionally wherein the inactivated furin cleavage site is QQAQ (SEQ ID NO: 7), T82I, D240G, S464N, D601 G, and A688V, wherein the amino acids are numbered with respect to a CoV S polypeptide having an amino acid sequence of SEQ ID NO: 2, comprises a signal peptide of SEQ ID NO: 154.

In embodiments, the CoV S polypeptide contains one or more modifications selected from: K973P, V974P, an inactivated furin cleavage site, optionally wherein the inactivated furin cleavage site is QQAQ (SEQ ID NO: 7), deletion of amino acid 56, deletion of amino acid 57, deletion of amino acid 131, a N488Y mutation, an A557D mutation, a D601G mutation, a P668H mutation, a T703I mutation, a S969A mutation, and a D1105H mutation, wherein the CoV S polypeptide is numbered with respect to the wild-type SARS-CoV-2 S polypeptide having the amino acid sequence of SEQ ID NO: 2. In embodiments, the CoV S polypeptide contains one or more modifications selected from: K973P, V974P, an inactivated furin cleavage site, optionally wherein the inactivated furin cleavage site is QQAQ (SEQ ID NO: 7), deletion of amino acid 56, deletion of amino acid 57, deletion of amino acid 132, a N488Y mutation, an A557D mutation, a D601G mutation, a P668H mutation, a T703I mutation, a S969A mutation, and a D1105H mutation, wherein the CoV S polypeptide is numbered with respect to the wild-type SARS-CoV-2 S polypeptide having the amino acid sequence of SEQ ID NO: 2.

In embodiments, the CoV S polypeptide contains one or more modifications selected from: K973P, V974P, an inactivated furin cleavage site, optionally wherein the inactivated furin cleavage site is QQAQ (SEQ ID NO: 7), a D67A mutation, a L229H mutation, a R233I mutation, an A688V mutation, an N488Y mutation, a K404N mutation, a E471K mutation, and a D601G mutation, wherein the CoV S polypeptide is numbered with respect to the wild-type SARS-CoV-2 S polypeptide having the amino acid sequence of SEQ ID NO: 2.

In embodiments, the CoV S polypeptide contains one or more modifications selected from: K973P, V974P, an inactivated furin cleavage site, optionally wherein the inactivated furin cleavage site is QQAQ (SEQ ID NO: 7), a L5F mutation, a T7N mutation, a P13S mutation, a D125Y mutation, a R177S mutation, a K404T mutation, a E471K mutation, a N488Y mutation, a D601G mutation, a H642Y mutation, a T1014I mutation, and a Ti 163F mutation, wherein the CoV S polypeptide is numbered with respect to the wild-type SARS-CoV-2 S polypeptide having the amino acid sequence of SEQ ID NO: 2.

In embodiments, the CoV S polypeptide contains one or more modifications selected from: K986P, V987P, an inactivated furin cleavage site, optionally wherein the inactivated furin cleavage site is QQAQ (SEQ ID NO: 7), a S131 mutation, a W152C mutation, and a L452R mutation, wherein the CoV S polypeptide is numbered with respect to the wild-type SARS-CoV-2 S polypeptide having the amino acid sequence of SEQ ID NO: 1. In embodiments, the CoV S polypeptide contains one or more modifications selected from: K986P, V987P, an inactivated furin cleavage site, optionally wherein the inactivated furin cleavage site is QQAQ (SEQ ID NO: 7), a S131 mutation, a W152C mutation, and a L452R mutation, wherein the CoV S polypeptide is numbered with respect to the wild-type SARS-CoV-2 S polypeptide having the amino acid sequence of SEQ ID NO: 1 lacks an N-terminal signal peptide.

In embodiments, the CoV Spike (S) polypeptides comprise a polypeptide linker. In embodiments, the polypeptide linker contains glycine and serine. In embodiments, the linker has about 50%, about 55%, about 60%, about 65%, about 70%, about 75%, about 80%, about 85%, about 90%, about 95%, or about 100% glycine.

In embodiments, the polypeptide linker has a repeat of $(SGGG)_n$ (SEQ ID NO: 91), wherein n is an integer from 1 to 50 (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50). In embodiments, the polypeptide linker has an amino acid sequence corresponding to SEQ ID NO: 90.

In embodiments, the polypeptide linker has a repeat of $(GGGGS)_n$(SEQ ID NO: 93), wherein n is an integer from 1 to 50 (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50).

In embodiments, the polypeptide linker has a repeat of $(GGGS)_n$ (SEQ ID NO: 92), wherein n is an integer from 1 to 50 (e.g. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50).

In aspects, the polypeptide linker is a poly-(Gly)n linker, wherein n is 1, 2, 3, 4, 5, 6, 7, 8, 9, 10, 15, 16, 17, 18, 19, or 20. In other embodiments, the linker is selected from the group consisting of: dipeptides, tripeptides, and quadripeptides. In embodiments, the linker is a dipeptide selected from the group consisting of alanine-serine (AS), leucine-glutamic acid (LE), and serine-arginine (SR).

In embodiments, the polypeptide linker comprises between 1 to 100 contiguous amino acids of a naturally occurring CoV S polypeptide or of a CoV S polypeptide disclosed herein. In embodiments, the polypeptide linker has an amino acid sequence corresponding to SEQ ID NO: 94.

In embodiments, the CoV Spike (S) polypeptides comprise a foldon. In embodiments, the TMCT is replaced with a foldon. In embodiments, a foldon causes trimerization of the CoV Spike (S) polypeptide. In embodiments, the foldon is an amino acid sequence known in the art. In embodiments, the foldon has an amino acid sequence of SEQ ID NO: 68. In embodiments, the foldon is a T4 fibritin trimerization motif. In embodiments, the T4 fibritin trimerization domain has an amino acid sequence of SEQ ID NO: 103. In embodiments, the foldon is separated in amino acid sequence from the CoV Spike (S) polypeptide by a polypeptide linker. Non-limiting examples of polypeptide linkers are found throughout this disclosure.

In embodiments, the disclosure provides CoV S polypeptides comprising a fragment of a coronavirus S protein and nanoparticles and vaccines comprising the same. In embodiments, the fragment of the coronavirus S protein is between about 10 and about 1500 amino acids in length (e.g. about 10, about 20, about 30, about 40, about 50, about 60, about 70, about 80, about 90, about 100, about 150, about 200, about 250, about 300, about 350, about 400, about 450, about 500, about 550, about 600, about 650, about 700, about 750, about 800, about 850, about 900, about 950, about 1000, about 1050, about 1100, about 1150, about 1200, about 1250, about 1300, about 1350, about 1400, about 1450, or about 1500 amino acids in length). In embodiments, the fragment of the coronavirus S protein is selected from the group consisting of the receptor binding domain (RBD), subdomain 1, subdomain 2, upper helix, fusion peptide, connecting region, heptad repeat 1, central helix, heptad repeat 2, NTD, and TMCT.

In embodiments, the CoV S polypeptide comprises an RBD and a subdomain 1. In embodiments, the CoV S polypeptide comprising an RBD and a subdomain 1 is amino acids 319 to 591 of SEQ ID NO: 1.

In embodiments, the CoV S polypeptide contains a fragment of a coronavirus S protein, wherein the fragment of the coronavirus S protein is the RBD. Non-limiting examples of RBDs include the RBD of SARS-CoV-2 (amino acid sequence=SEQ ID NO: 69), the RBD of SARS (amino acid sequence=SEQ ID NO: 70), and the RBD of MERS, (amino acid sequence=SEQ ID NO: 71).

In embodiments, the CoV S polypeptide contains two or more RBDs, which are connected by a polypeptide linker. In embodiments, the polypeptide linker has an amino acid sequence of SEQ ID NO: 90 or SEQ ID NO: 94.

In embodiments, the CoV S polypeptide contains 1, 2, 3, 4, 5, 6, 7, 8, 9, 10, 11, 12, 13, 14, 15, 16, 17, 18, 19, or 20 RBDs.

In some embodiments, the CoV S polypeptide contains two or more SARS-CoV-2 RBDs, which are connected by a polypeptide linker. In embodiments, the antigen containing two or more SARS-CoV-2 RBDs has an amino acid sequence corresponding to one of SEQ ID NOS: 72-75.

In embodiments, the CoV S polypeptide contains a SARS-CoV-2 RBD and a SARS RBD. In embodiments, the CoV S polypeptide comprises a SARS-CoV-2 RBD and a SARS RBD, wherein each RBD is separated by a polypeptide linker. In embodiments, the CoV S polypeptide comprising a SARS-CoV-2 RBD and a SARS RBD has an amino acid sequence selected from the group consisting of SEQ ID NOS: 76-79.

In embodiments, the CoV S polypeptide contains a SARS-CoV-2 RBD and a MERS RBD. In embodiments, the CoV S polypeptide comprises a SARS-CoV-2 RBD and a MERS RBD, wherein each RBD is separated by a polypeptide linker.

In embodiments, the CoV S polypeptide comprises a SARS RBD and a MERS RBD. In embodiments, the CoV S polypeptide comprises a SARS RBD and a MERS RBD, wherein each RBD is separated by a polypeptide linker.

In embodiments, the CoV S polypeptide contains a SARS-CoV-2 RBD, a SARS RBD, and a MERS RBD. In embodiments, the CoV S polypeptide contains a SARS-CoV-2 RBD, a SARS RBD, and a MERS RBD, wherein each RBD is separated by a polypeptide linker. In embodiments, the CoV S polypeptide comprising a SARS-CoV-2 RBD, a SARS RBD, and a MERS RBD has an amino acid sequence selected from the group consisting of SEQ ID NOS: 80-83.

In embodiments, the CoV S polypeptides described herein are expressed with an N-terminal signal peptide. In embodiments, the N-terminal signal peptide has an amino acid sequence of SEQ ID NO: 5 (MFVFLVLLPLVSS). In embodiments, the N-terminal signal peptide has an amino acid sequence of SEQ ID NO: 117 (MFVFLVLLPLVSI). In embodiments, the N-terminal signal peptide has an amino acid sequence of SEQ ID NO: 154 (MFVFFVLLPLVSS). In embodiments, the signal peptide may be replaced with any signal peptide that enables expression of the CoV S protein. In embodiments, one or more of the CoV S protein signal peptide amino acids may be deleted or mutated. An initiating methionine residue is maintained to initiate expression. In embodiments, the CoV S polypeptides are encoded by a nucleic acid sequence selected from the group consisting of SEQ ID NO: 35, SEQ ID NO: 37, SEQ ID NO: 95, SEQ ID NO: 43, SEQ ID NO: 47, SEQ ID NO: 50, SEQ ID NO: 53, SEQ ID NO: 55, SEQ ID NO: 57, SEQ ID NO: 96, SEQ ID NO: 60, SEQ ID NO: 131, SEQ ID NO: 135, SEQ ID NO: 142, SEQ ID NO. 145, SEQ ID NO. 148, and SEQ ID NO: 150. In embodiments, the N-terminal signal peptide of the CoV S polypeptide contains a mutation at Ser-13 relative to the native CoV Spike (S) signal polypeptide (SEQ ID NO: 5). In embodiments, Ser-13 is mutated to any natural amino acid. In embodiments, Ser-13 is mutated to alanine, methionine, isoleucine, leucine, threonine, or valine. In embodiments, Ser-13 is mutated to isoleucine.

Following expression of the CoV S protein in a host cell, the N-terminal signal peptide is cleaved to provide the mature CoV protein sequence (SEQ ID NOS: 2, 4, 38, 41, 44, 48, 51, 54, 58, 61, 63, 65, 67, 73, 75, 78, 79, 82, 83, 85, 87, 89, 106, 110, 132, 133, 114, 138, 141, 144,147, 151, 153, 156, and 158). In embodiments, the signal peptide is cleaved by host cell proteases. In aspects, the full-length protein may be isolated from the host cell and the signal peptide cleaved subsequently.

Following cleavage of the signal peptide from the CoV Spike (S) polypeptide with an amino acid sequence corresponding to SEQ ID NOS: 1, 3, 36, 40, 42, 46, 49, 52, 56, 59, 62, 64, 66, 72, 74, 76, 77, 80, 81, 84, 86, 87, 105, 107, 88, 109, 130, 134, 136, 137, 140, 143, 146, 149, 152, 155, 157, 159-163 during expression and purification, a mature polypeptide having an amino acid sequence selected from the group consisting of SEQ ID NOS: 2, 4, 38, 41, 44, 48, 51, 54, 58, 61, 63, 65, 67, 73, 75, 78, 79, 82, 83, 85, 106, 108, 89, and 110, 112-115, 132, 133, 114, 138, 141, 144, 147, 151, 153, 156, 158, 164-168 is obtained and used to produce a CoV S nanoparticle vaccine or CoV S nanoparticles.

Advantageously, the disclosed CoV S polypeptides may have enhanced protein expression and stability relative to the native CoV Spike (S) protein.

In embodiments, the CoV S polypeptides described herein contain further modifications from the native coronavirus S protein (SEQ ID NO: 2). In embodiments, the coronavirus S proteins described herein exhibit at least 80%, or at least 90%, or at least 95%, or at least 97%, or at least 99% identity to the native coronavirus S protein. A person of skill in the art would use known techniques to calculate the percent identity of the recombinant coronavirus S protein to the native protein or to any of the CoV S polypeptides described herein. For example, percentage identity can be calculated using the tools CLUSTALW2 or Basic Local Alignment Search Tool (BLAST), which are available online. The following default parameters may be used for CLUSTALW2 Pairwise alignment: Protein Weight Matrix=Gonnet; Gap Open=10; Gap Extension=0.1.

In embodiments, the amino acid sequence of the CoV S polypeptides described herein is at least 91%, at least 92%, at least 93%, at least 94%, 95%, at least 96%, at least 97%, at least 98%, at least 99%, at least 99.5% identical, or 100% identical to the CoV S polypeptide having an amino acid sequence of SEQ ID NO: 87. A CoV S polypeptide may have a deletion, an insertion, or mutation of up to about 1, up to about 2, up to about 3, up to about 4, up to about 5, up to about 10, up to about 15, up to about 20, up to about 25, up to about 30, up to about 35, up to about 40, up to about 45, or up to about 50 amino acids compared to the amino acid sequence of the CoV S polypeptide having an amino acid sequence of SEQ ID NO: 87. A CoV S polypeptide may have may have a deletion, an insertion, or mutation of between about 1 and about 5 amino acids, between about 3 and about 10 amino acids, between about 5 and 10 amino acids, between about 8 and 12 amino acids, between about 10 and 15 amino acids, between about 12 and 17 amino acids, between about 15 and 20 amino acids, between about 18 and 23 amino acids, between about 20 and 25 amino acids, between about 22 and about 27 amino acids, between about 25 and 30 amino acids, between about 30 and 35 amino acids, between about 35 and 40 amino acids, between about 40 and 45 amino acids, or between about 45 and 50 amino acids, as compared to the CoV S polypeptide having an amino acid sequence of SEQ ID NO: 87. In embodiments, the CoV S polypeptides described herein comprise about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, or about 25 substitutions compared to the coronavirus S protein (SEQ ID NO: 87).

In embodiments, the CoV S polypeptides described herein are at least 95%, at least 96%, at least 97%, at least 98%, at least 99%, or at least 99.5% identical to the CoV S polypeptide having an amino acid sequence selected from any one of SEQ ID NOS: 2, 4, 38, 41, 44, 48, 51, 54, 58, 61, 63, 65, 67, 73, 75, 78, 79, 82, 83, 85, 106, 108, 89, and 110, 112-115, 132, 133, 114, 138, 141, 144, 147, 151, 153, 156, and 158, 164-168.

In embodiments, the coronavirus S polypeptide is extended at the N-terminus, the C-terminus, or both the N-terminus and the C-terminus. In aspects, the extension is a tag useful for a function, such as purification or detection. In aspects the tag contains an epitope. For example, the tag may be a polyglutamate tag, a FLAG-tag, a HA-tag, a polyHis-tag (having about 5-10 histidines) (SEQ ID NO: 101), a hexahistidine tag (SEQ ID NO: 100), an 8X-His-tag (having eight histidines) (SEQ ID NO: 102), a Myc-tag, a Glutathione-S-transferase-tag, a Green fluorescent protein-tag, Maltose binding protein-tag, a Thioredoxin-tag, or an Fc-tag. In other aspects, the extension may be an N-terminal signal peptide fused to the protein to enhance expression. While such signal peptides are often cleaved during expression in the cell, some nanoparticles may contain the antigen with an intact signal peptide. Thus, when a nanoparticle comprises an antigen, the antigen may contain an extension and thus may be a fusion protein when incorporated into nanoparticles. For the purposes of calculating identity to the sequence, extensions are not included. In embodiments, the tag is a protease cleavage site. Non-limiting examples of protease cleavage sites include the HRV3C protease cleavage site, chymotrypsin, trypsin, elastase, endopeptidase, caspase-1, caspase-2, caspase-3, caspase-4, caspase-5, caspase-6, caspase-7, caspase-8, caspase-9, caspase-10, enterokinase, factor Xa, Granzyme B, TEV protease, and thrombin. In embodiments, the protease cleavage site is an HRV3C protease cleavage site. In embodiments, the protease cleavage site comprises an amino acid sequence of SEQ ID NO: 98.

In embodiments, the CoV S glycoprotein comprises a fusion protein. In embodiments, the CoV S glycoprotein comprises an N-terminal fusion protein. In embodiments, the Cov S glycoprotein comprises a C-terminal fusion protein. In embodiments, the fusion protein encompasses a tag useful for protein expression, purification, or detection. In embodiments, the tag is a polyHis-tag (having about 5-10 histidines), a Myc-tag, a Glutathione-S-transferase-tag, a Green fluorescent protein-tag, Maltose binding protein-tag, a Thioredoxin-tag, a Strep-tag, a Twin-Strep-tag, or an Fc-tag. In embodiments, the tag is an Fc-tag. In embodiments, the Fc-tag is monomeric, dimeric, or trimeric. In embodiments, the tag is a hexahistidine tag, e.g. a polyHis-tag which contains six histidines (SEQ ID NO: 100). In embodiments, the tag is a Twin-Strep-tag with an amino acid sequence of SEQ ID NO: 99.

In embodiments, the CoV S polypeptide is a fusion protein comprising another coronavirus protein. In embodiments, the other coronavirus protein is from the same coronavirus. In embodiments, the other coronavirus protein is from a different coronavirus.

In aspects, the CoV S protein may be truncated. For example, the N-terminus may be truncated by about 10 amino acids, about 30 amino acids, about 50 amino acids, about 75 amino acids, about 100 amino acids, or about 200 amino acids. The C-terminus may be truncated instead of or in addition to the N-terminus. For example, the C-terminus may be truncated by about 10 amino acids, about 30 amino acids, about 50 amino acids, about 75 amino acids, about 100 amino acids, or about 200 amino acids. For purposes of calculating identity to the protein having truncations, identity is measured over the remaining portion of the protein.

Detergent-Core Nanoparticles Containing CoV Spike (S) Polypeptides

In embodiments, the compositions disclosed herein comprise detergent-core nanoparticles comprising a CoV S polypeptide, which is associated with a detergent core.

In embodiments, nanoparticles of the present disclosure comprise a mature CoV S polypeptide. In embodiments, the nanoparticles of the present disclosure comprise CoV S polypeptides associated with a detergent core. The presence of the detergent facilitates formation of the nanoparticles by forming a core that organizes and presents the antigens. In embodiments, the nanoparticles may contain the CoV S polypeptides assembled into multi-oligomeric glycoprotein-detergent (e.g. PS80) nanoparticles with the head regions projecting outward and hydrophobic regions and PS80 detergent forming a central core surrounded by the glycoprotein. In embodiments, the CoV S polypeptide inherently contains or is adapted to contain a transmembrane domain to promote association of the protein into a detergent core. In embodiments, the CoV S polypeptide contains a head domain. Primarily the transmembrane domains of a CoV S polypeptide trimer associate with detergent; however, other portions of the polypeptide may also interact. Advantageously, the nanoparticles have improved resistance to environmental stresses such that they provide enhanced stability and/or improved presentation to the immune system due to organization of multiple copies of the protein around the detergent.

In embodiments, the detergent core is a non-ionic detergent core. In embodiments, the CoV S polypeptide is associated with the non-ionic detergent core. In embodiments, the detergent is selected from the group consisting of polysorbate-20 (PS20), polysorbate-40 (PS40), polysorbate-60 (PS60), polysorbate-65 (PS65) and polysorbate-80 (PS80). In embodiments, the detergent is PS80.

In embodiments, the CoV S polypeptide forms a trimer. In embodiments, the CoV S polypeptide nanoparticles are composed of multiple polypeptide trimers surrounding a non-ionic detergent core. In embodiments, the nanoparticles contain at least about 1 trimer or more. In embodiments, the nanoparticles contain at least about 5 trimers to about 30 trimers of the Spike protein. In embodiments, each nanoparticle may contain 1, 2, 3, 4, 5, 6, 7, 8, 9, 10, 11, 12, or 15, 20, 25, or 30 trimers, including all values and ranges in between. Compositions disclosed herein may contain nanoparticles having different numbers of trimers. For example, a composition may contain nanoparticles where the number of trimers ranges from 2-9; in embodiments, the nanoparticles in a composition may contain from 2-6 trimers. In embodiments, the compositions contain a heterogeneous population of nanoparticles having 2 to 6 trimers per nanoparticle, or 2 to 9 trimers per nanoparticle. In embodiments, the compositions may contain a substantially homogenous population of nanoparticles. For example, the population may contain about 95% nanoparticles having 5 trimers.

The nanoparticles disclosed herein range in particle size. In embodiments, the nanoparticles disclosed herein range in particle size from a Z-ave size from about 20 nm to about 60 nm, about 20 nm to about 50 nm, about 20 nm to about 45 nm, about 20 nm to about 35 nm, about 20 nm to about 30 nm, about 25 nm to about 35 nm, or about 25 nm to about 45 nm. Particle size (Z-ave) is measured by dynamic light scattering (DLS) using a Zetasizer NanoZS (Malvern, UK), unless otherwise specified.

In embodiments, the nanoparticles comprising the CoV S polypeptides disclosed herein have a reduced particle size compared to nanoparticles comprising a wild-type CoV S polypeptide. In embodiments, the CoV S polypeptides are at least about 40% smaller in particle size, for example, at least about 40%, at least about 45%, at least about 50%, at least about 55%, at least about 60%, at least about 65%, at least about 70%, at least about 75%, at least about 80%, or at least about 85% smaller in particle size.

The nanoparticles comprising CoV S polypeptides disclosed herein are more homogenous in size, shape, and mass than nanoparticles comprising a wild-type CoV S polypeptide. The polydispersity index (PDI), which is a measure of heterogeneity, is measured by dynamic light scattering using a Malvern Setasizer unless otherwise specified. In embodiments, the particles measured herein have a PDI from about 0.2 to about 0.45, for example, about 0.2, about 0.25, about 0.29, about 0.3, about 0.35, about 0.40, or about 0.45. In embodiments, the nanoparticles measured herein have a PDI that is at least about 25% smaller than the PDI of nanoparticles comprising the wild-type CoV S polypeptide, for example, at least about 25%, at least about 30%, at least about 35%, at least about 40%, at least about 45%, at least about 50%, at least about 55%, or at least about 60%, smaller.

The CoV S polypeptides and nanoparticles comprising the same have improved thermal stability as compared to the wild-type CoV S polypeptide or a nanoparticle thereof. The thermal stability of the CoV S polypeptides is measured using differential scanning calorimetry (DSC) unless otherwise specified. The enthalpy of transition (ΔHcal) is the energy required to unfold a CoV S polypeptide. In embodiments, the CoV S polypeptides have an increased ΔHcal as compared to the wild-type CoV S polypeptide. In embodiments, the ΔHcal of a CoV S polypeptide is about 2-fold, about 3-fold, about 4-fold, about 5-fold, about 6-fold, about 7-fold, about 8-fold, about 9-fold, or about 10-fold greater than the ΔHcal of a wild-type CoV S polypeptide.

Several nanoparticle types may be included in vaccine compositions disclosed herein. In aspects, the nanoparticle type is in the form of an anisotropic rod, which may be a dimer or a monomer. In other aspects, the nanoparticle type is a spherical oligomer. In yet other aspects, the nanoparticle may be described as an intermediate nanoparticle, having sedimentation properties intermediate between the first two types. Formation of nanoparticle types may be regulated by controlling detergent and protein concentration during the production process. Nanoparticle type may be determined by measuring sedimentation co-efficient.

(ii) At Least Three HA Glycoproteins

In embodiments, an immunogenic composition of the disclosure comprises at least three HA glycoproteins or at least four HA glycoproteins. In embodiments, an immunogenic composition of the disclosure comprises three or four HA glycoproteins. In embodiments, each of the HA glycoproteins are from a different influenza strain. In embodiments, three HA glycoproteins are from a Type A influenza strain, and one HA glycoprotein is from a Type B influenza strain. In embodiments, two HA glycoproteins are from a Type A influenza strain, and two HA glycoproteins are from a Type B influenza strain. In embodiments, two HA glycoproteins are from a Type A influenza strain, and one HA glycoprotein is from a Type B influenza strain.

In embodiments, each of the at least three HA glycoproteins is isolated separately using an egg-based manufacturing process. In embodiments, an egg-based manufacturing process comprises (a) propagating an influenza virus in an egg and (b) harvesting the influenza virus.

In embodiments, the influenza virus is a live virus. In embodiments, the influenza virus is a weakened or "attenuated" virus. In embodiments, the influenza virus is optimized to grow in an egg. In embodiments, the optimized influenza virus lacks the polybasic cleavage site of hemagglutinin. The following article describes the development of an optimized influenza virus (referred to as a "candidate vaccine virus") in detail and is incorporated by reference herein in its entirety: Belser et al. Virology. 2017 November; 511: 135-141.

In embodiments, the egg is a chicken egg. In embodiments, the chicken egg is an embryonated chicken egg. In embodiments, the egg is a pathogen-free egg. In embodiments, an influenza virus is propagated by inoculating the virus in the allantoic cavity of an embryonated chicken egg. The following article describes an exemplary inoculation method and is incorporated by reference herein in its entirety: Brauer et al. J Vis Exp. 2015; (97): 52421.

In embodiments, the egg-based manufacturing process comprises purifying the influenza virus. In embodiments, an influenza virus is purified using any of the following techniques: centrifugation, chromatography, precipitation, or nanofiltration. In embodiments, the centrifugation technique is ultracentrifugation. In embodiments, the virus is purified using zonal centrifugation. In embodiments, the zonal centrifugation is continuous flow zonal centrifugation.

In embodiments, the egg-based manufacturing process comprises inactivating (also referred to herein as "killing") an influenza virus. In embodiments, an influenza virus is inactivated using low pH (e.g., a pH from about 3.5-5.5), heat, ethanol, ultraviolet light, exposure to a detergent (e.g., octylphenol), or exposure to a chemical (e.g., 2-propanol, ethanol, iodopovidone). In embodiments, the purified virus is inactivated with ultraviolet light, betapropiolactone, sodium deoxycholate, formaldehyde, or any combination thereof.

In embodiments, the egg-based manufacturing process comprises exposing the influenza virus to a surfactant. The surfactant may be sodium taurodeoxycholate, octylphenol ethoxylate (Triton®-X 100), or cetyl trimethyl ammonium bromide. Exposing an influenza virus to a surfactant results in the formation of an influenza split-virion. In embodiments, the at least three HA glycoproteins are in the form of an influenza split-virion.

In embodiments, the egg-based manufacturing process comprises purifying an influenza antigen (e.g., hemagglutinin) from the virus.

The following Food and Drug Administration (FDA) approved influenza vaccines are produced using an egg-based manufacturing process: AFLURIA® QUADRIVALENT, FLUARIX® QUADRIVALENT, FLULAVAL QUADRIVALENT, FLUZONE® QUADRIVALENT, FLUZONE® HIGH-DOSE QUADRIVALENT, FLUMIST® QUADRIVALENT, FLUAD®, and FLUAD® QUADRIVALENT.

In embodiments, each of the at least three HA glycoproteins is isolated using a cell-culture based process. In embodiments, a cell-culture based process comprises (i) growing an influenza virus in a cell and (ii) harvesting the virus from the cell. In embodiments, a cell-culture based process comprises (i) transfecting a cell with a vector comprising a hemagglutinin and (ii) harvesting the hemagglutinin from the cell. In embodiments, a cell-culture based process comprises (i) transducing a cell with a virus encoding a hemagglutinin and (ii) harvesting the hemagglutinin from the cell. In embodiments, the harvested hemagglutinin is recombinant hemagglutinin.

In embodiments, the cell is an animal cell, a bacterial cell, an insect cell, or a fungal cell. In embodiments, the animal is a human, a bird (e.g., a chicken), a dog, a reptile, a goat, a pig, a mouse, a rabbit, or a rat.

In embodiments, the virus encoding a hemagglutinin is a baculovirus, a lentivirus, or an adeno-associated virus.

In embodiments, an influenza virus produced using a cell-culture based process is purified. Any of the purification techniques described to purify influenza virus produced using an egg-based manufacturing process can be used to purify influenza virus produced using a cell-cultured based process.

In embodiments, a hemagglutinin produced using a cell-culture based process is purified. Purification techniques include chromatography, centrifugation, precipitation, and nanofiltration.

The Food and Drug Administration (FDA) approved influenza vaccine FLUCELVAX® QUADRIVALENT is produced using a cell-culture based process.

In embodiments, each of the at least three HA glycoproteins is a recombinant hemagglutinin. The Food and Drug Administration (FDA) approved influenza vaccine FLUBLOK® QUADRIVALENT is a recombinant hemagglutinin.

In embodiments, the at least three hemagglutinins are in the form of recombinant hemagglutinin. Recombinant hemagglutinin is isolated from a cell that produces hemagglutinin. In embodiments, a cell that produces hemagglutinin has been transfected with a vector encoding hemagglutinin. In embodiments, a cell that produces hemagglutinin has been transduced with a virus encoding hemagglutinin.

(iia) At Least Three HA Glycoproteins-Detergent-Core Nanoparticles Comprising Hemagglutinin In embodiments, the compositions disclosed herein comprise detergent-core nanoparticles comprising hemagglutinin from an influenza virus. The aforementioned detergent-core nanoparticles are described in detail in U.S. Pat. No. 10,426,829, which is incorporated herein by reference in its entirety for all purposes.

Detergent-core nanoparticles comprise a hemagglutinin from an influenza virus, which is associated with a detergent core. In embodiments, the hemagglutinin is a trimer. Each nanoparticle may contain 1, 2, 3, 4, 5, 6, 7, 8, 9, 10, 11, 12, 13, 14, or 15 trimers. In embodiments, the nanoparticle contains between about 2 to about 9, about 2 to about 6, or about 5 hemagglutinin trimers. The hemagglutinin is associated with the non-ionic detergent containing core of the nanoparticle. In embodiments, the detergent is selected from polysorbate-20 (PS20), polysorbate-40 (PS40), polysorbate-60 (PS60), polysorbate-65 (PS65) and polysorbate-80 (PS80). The presence of the detergent facilitates formation of the nanoparticles by forming a core that organizes and presents the antigens. In embodiments, the nanoparticles may contain the antigens assembled into multi-oligomeric glycoprotein-PS80 protein-detergent nanoparticles with the head regions projecting outward and hydrophobic regions and PS80 detergent forming a central core surrounded by the antigens.

The nanoparticles disclosed herein range in Z-ave size from about 20 nm to about 60 nm, about 20 nm to about 50 nm, about 20 nm to about 45 nm, or about 25 nm to about 45 nm.

Figure 7:
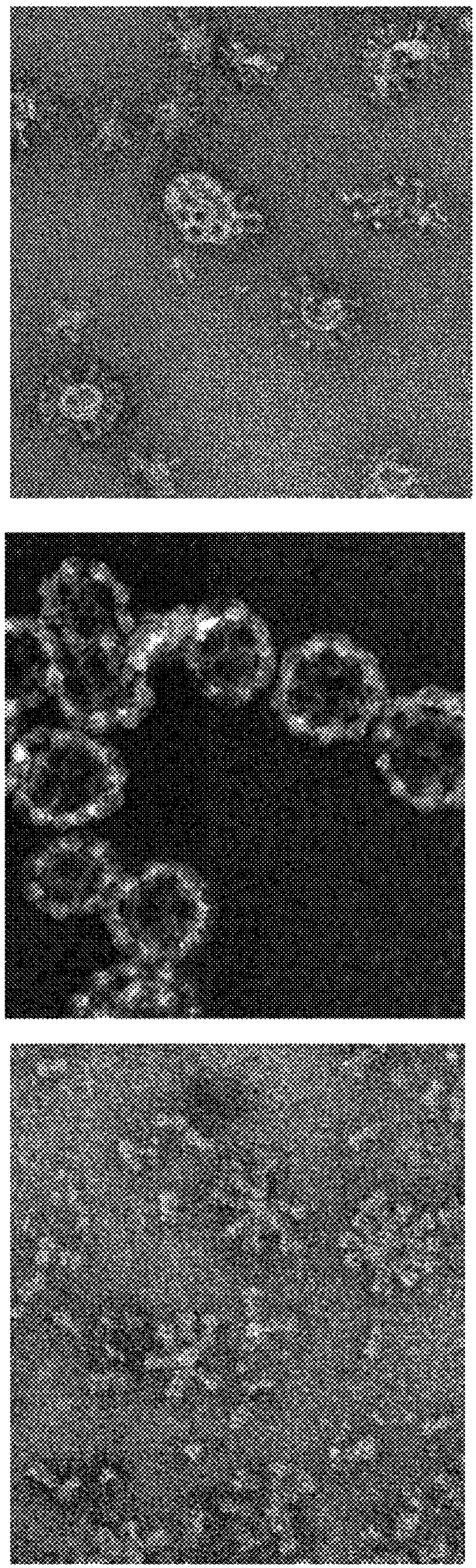
FIG. 7 shows examples of transmission electron microscopy (TEM) images of influenza HA detergent core nanoparticles alone (left), saponin adjuvant alone (middle) (i.e. 85% Fraction A ISCOM matrix and 15% Fraction C ISCOM matrix), and the combination of HA nanoparticles and saponin adjuvant, which forms Hemagglutinin Saponin Matrix Nanoparticles (HaSMaNs) (right).

In embodiments, a detergent-core nanoparticle is produced in insect cells by expressing HA proteins using a baculovirus expression system and extracting the HA protein with a detergent. During purification, the first detergent is exchanged for a second detergent, typically a non-ionic detergent resulting in nanoparticles having a non-ionic detergent core in which the transmembrane domain of the HA protein, in trimer form, is embedded into. FIG. 7 (left panel) illustrates these structures as observed under an electron microscope.

The hemagglutinin contained in the detergent-core nanoparticles or in the HaSMaNs described herein may be from any influenza virus strain. Human influenza Type A and Type B viruses cause seasonal epidemics of disease almost every winter in the United States.

The HA protein may be selected from the sub-types H1, H2, H3, H4, H5, H6, H7, H8, H9, H10, H11, H12, H13, H14, H15, H16, H17, and H18. Phylogenetically, the influenza is split into groups. For HA, Group 1 contains H1, H2, H5, H6, H8, H9, H11, H12, H13, H16, H17, and H18 and group 2 contains H3, H4, H7, H10, H14, and H15.

In embodiments, the detergent-core nanoparticles or HaSMaNs are trypsin-resistant nanoparticles produced using neutral pH purification. Trypsin resistance is achieved by neutral pH range of above 6.9 to 8.5 during purification and formulation of the HA nanoparticles. Trypsin resistant influenza glycoproteins and trypsin resistant influenza nanoparticles; and methods of making thereof are described in detail in U.S. Pat. No. 10,426,829.

In embodiments, the hemagglutinin of the detergent-core nanoparticles or HaSMaNs described herein comprises the full-length wild type hemagglutinin amino acid sequence. In embodiments, the hemagglutinin is a hemagglutinin variant. In embodiments, the hemagglutinin exhibits at least 80%, at least 85%, at least 90%, at least 95%, at least 97%, at least 98%, or at least 99% identity to the wild-type hemagglutinin protein. Percentage identity can be calculated using the alignment program ClustalW2, available at www.ebi.ac.uk/Tools/msa/clustalw2/. The following default parameters may be used for Pairwise alignment: Protein Weight Matrix=Gonnet; Gap Open=10; Gap Extension=0.1.

HA is a homotrimer with each monomer consisting of ~550 amino acid residues. Each monomer of HA has been conceptually divided into three domains: the ectodomain of ~515 residues constitutes the extraviral part of the molecule; a single stretch of 27 residues defines the transmembrane (TM) domain; and ~10 residues constitute the cytoplasmic tail (CT). While some changes may be made to hemagglutinin, formation of both detergent core nanoparticles and HaSMaNs requires an intact transmembrane domain (TM). Thus, in particular examples, a modified HA protein sequence comprises 100% identity to the wild-type TM and CT domains with some flexibility in the remaining ectodomain portion, where identity may be at least 90% or at least 95%. The domains may be identified by homology to the amino acid sequences of the TM domains and CT of Japan/305/57 HA shown in FIG. 1 of Melikyan et al. (Mol Biol Cell. 1999 June; 10(6): 1821-1836) though it should be noted that the boundaries between ectodomain, TM, and CT domains may vary from HA protein to HA protein by up to three amino acids.

(iib) Influenza Vaccine—HaSAlaNs (Hemagglutinin Saponin Matrix Nanoparticles)

In embodiments, the immunogenic compositions and vaccine compositions described herein comprise a HaSMaN (Hemagglutinin Saponin Matrix Nanoparticle.) FIG. 7 (right panel) illustrates HaSMaN structures as observed under an electron microscope. The HA glycoproteins decorate the Matrix cage-like structures. The HaSMaN structures are formed by preparing detergent-corenanoparticles comprising hemagglutinin from an influenza virus and then incubating them with ISCOM matrix adjuvant particles for a period of time. ISCOM matrix particles are shown in the center panel of FIG. 7. Notably, the HaSMaNs form readily with Type A influenza HA proteins, but not Type B influenza HA proteins.

HaSMaNs disclosed herein are produced by incubating the detergent-core nanoparticles with an ISCOM Matrix adjuvant comprising a saponin fraction, cholesterol and a phospholipid. In embodiments, a HaSMaN is formed by incubating a detergent-core nanoparticle with an ISCOM matrix adjuvant for between about 24 hours and about 48 hours. For example, the detergent-core nanoparticle may be incubated with an ISCOM matrix adjuvant for about 24 hours, about 25 hours, about 26 hours, about 27 hours, about 28 hours, about 29 hours, about 30 hours, about 31 hours, about 32 hours, about 33 hours, about 34 hours, about 35 hours, about 36 hours, about 37 hours, about 38 hours, about 39 hours, about 40 hours, about 41 hours, about 42 hours, about 43 hours, about 44 hours, about 45 hours, about 46 hours, about 47 hours, about 48 hours, or more. In some embodiments, a HaSMaN is formed by incubating a detergent-core nanoparticle with an ISCOM matrix adjuvant for at least about 24 hours, at least about 25 hours, at least about 26 hours, at least about 27 hours, at least about 28 hours, at least about 29 hours, at least about 30 hours, at least about 31 hours, at least about 32 hours, at least about 33 hours, at least about 34 hours, at least about 35 hours, at least about 36 hours, at least about 37 hours, at least about 38 hours, at least about 39 hours, at least about 40 hours, at least about 41 hours, at least about 42 hours, at least about 43 hours, at least about 44 hours, at least about 45 hours, at least about 46 hours, at least about 47 hours, or at least about 48 hours. In embodiments, a HaSMaN is formed by incubating a detergent-core nanoparticle with an ISCOM matrix adjuvant at a temperature from about 4° C. to about 25° C. For example, the HaSMaN may be formed by incubating a detergent-core nanoparticle with an ISCOM matrix adjuvant at a temperature of about 4° C., about 5° C., about 6° C., about 7° C., about 8° C., about 9° C., about 10° C., about 11° C., about 12° C., about 13° C., about 14° C., about 15° C., about 16° C., about 17° C., about 18° C., about 19° C., about 20° C., about 21° C., about 22° C., about 23° C., about 24° C., about 25° C., or higher. In embodiments, a HaSMaN is formed by incubating a detergent-core nanoparticle with an ISCOM matrix adjuvant at a temperature of at least about 4° C., at least about 5° C., at least about 6° C., at least about 7° C., at least about 8° C., at least about 9° C., at least about 10° C., at least about 11° C., at least about 12° C., at least about 13° C., at least about 14° C., at least about 15° C., at least about 16° C., at least about 17° C., at least about 18° C., at least about 19° C., at least about 20° C., at least about 21° C., at least about 22° C., at least about 23° C., at least about 24° C., at least about 25° C. Typically, about 24 to 48 hours at 4° C. or 25° C. incubation is required for formation. Formation of HaSMaNs is promoted by higher temperatures. In embodiments, formation of HaSMaN occurs by incubation of detergent-core nanoparticles with an ISCOM Matrix adjuvant for at least 24 hours at about 25° C. Mixing detergent core nanoparticles with ISCOM Matrix adjuvant shortly prior to administering to a subject—i.e. bedside mix, does not produce HaSMaNs. Longer incubation periods do not negatively impact HaSMaNs formation.

Production of Detergent-Core Nanoparticles

The nanoparticles of the present disclosure are non-naturally occurring products, the components of which do not occur together in nature. In embodiments, the methods disclosed herein use a detergent exchange approach wherein a first detergent is used to isolate a protein and then that first detergent is exchanged for a second detergent to form the nanoparticles.

The antigens contained in the nanoparticles are typically produced by recombinant expression in host cells. Standard recombinant techniques may be used. In embodiments, the CoV S polypeptides are expressed in insect host cells using a baculovirus system. In embodiments, the baculovirus is a cathepsin-L knock-out baculovirus, a chitinase knock-out baculovirus. Optionally, the baculovirus is a double knock-out for both cathepsin-L and chitinase. High level expression may be obtained in insect cell expression systems. Non-limiting examples of insect cells are, *Spodoptera frugiperda* (Sf) cells, e.g. Sf9, Sf21, Trichoplusiani cells, e.g. High Five cells, and *Drosophila* S2 cells. In embodiments, the CoV S polypeptide or hemagglutinin described herein is produced in any suitable host cell. In embodiments, the host cell is an insect cell. In embodiments, the insect cell is an Sf9 cell.

Typical transfection and cell growth methods can be used to culture the cells. Vectors, e.g., vectors comprising polynucleotides that encode fusion proteins, can be transfected into host cells according to methods well known in the art. For example, introducing nucleic acids into eukaryotic cells can be achieved by calcium phosphate co-precipitation, electroporation, microinjection, lipofection, and transfection employing polyamine transfection reagents. In one embodiment, the vector is a recombinant baculovirus.

Methods to grow host cells include, but are not limited to, batch, batch-fed, continuous and perfusion cell culture techniques. Cell culture means the growth and propagation of cells in a bioreactor (a fermentation chamber) where cells propagate and express protein (e.g. recombinant proteins) for purification and isolation. Typically, cell culture is performed under sterile, controlled temperature and atmospheric conditions in a bioreactor. A bioreactor is a chamber used to culture cells in which environmental conditions such as temperature, atmosphere, agitation and/or pH can be monitored. In one embodiment, the bioreactor is a stainless steel chamber. In another embodiment, the bioreactor is a pre-sterilized plastic bag (e.g. Cellbag®, Wave Biotech, Bridgewater, N.J.). In other embodiment, the pre-sterilized plastic bags are about 50 L to 3500 L bags.

Extraction and Purification of Nanoparticles

After growth of the host cells, the protein or nanoparticle may be harvested from the host cells using detergents and purification protocols. Once the host cells have grown for 48 to 96 hours, the cells are isolated from the media and a detergent-containing solution is added to solubilize the cell membrane, releasing the protein in a detergent extract. Triton X-100 and TERGITOL® nonylphenol ethoxylate, also known as NP-9, are each preferred detergents for extraction. The detergent may be added to a final concentration of about 0.1% to about 1.0%. For example, the concentration may be about 0.1%, about 0.2%, about 0.3%, about 0.5%, about 0.7%, about 0.8%, or about 1.0%. The range may be about 0.1% to about 0.3%. In embodiments, the concentration is about 0.5%.

In embodiments aspects, different first detergents may be used to isolate the protein from the host cell. For example, the first detergent may be Bis(polyethylene glycol bis[imidazoylcarbonyl]), nonoxynol-9, Bis(polyethylene glycol bis [imidazoyl carbonyl]), BRIJ® Polyethylene glycol dodecyl ether 35, BRIJ® Polyethylene glycol (3) cetyl ether 56, BRIJ® alcohol ethoxylate 72, BRIJ Polyoxyl 2 stearyl ether 76, BRIJ® polyethylene glycol monoolelyl ether 92V, BRIJ® Polyoxyethylene (10) oleyl ether 97, BRIJ® Polyethylene glycol hexadecyl ether 58P, CREMOPHOR® EL Macrogolglycerol ricinoleate, Decaethyleneglycol monododecyl ether, N-Decanoyl-N-methylglucamine, n-Decyl alpha-Dglucopyranoside, Decyl beta-D-maltopyranoside, n-Dodecanoyl-N-methylglucamide, nDodecyl alpha-D-maltoside, n-Dodecyl beta-D-maltoside, n-Dodecyl beta-D-maltoside, Heptaethylene glycol monodecyl ether, Heptaethylene glycol monododecyl ether, Heptaethylene glycol monotetradecyl ether, n-Hexadecyl beta-D-maltoside, Hexaethylene glycol monododecyl ether, Hexaethylene glycol monohexadecyl ether, Hexaethylene glycol monooctadecyl ether, Hexaethylene glycol monotetradecyl ether, Igepal CA-630, Igepal CA-630, Methyl-6-0-(N-heptylcarbamoyl)-alpha-D-glucopyranoside, Nonaethylene glycol monododecyl ether, N-Nonanoyl-N-methylglucamine, N-NonanoylN-methylglucamine, Octaethylene glycol monodecyl ether, Octaethylene glycolmonododecyl ether, Octaethylene glycol monohexadecyl ether, Octaethylene glycol monooctadecyl ether, Octaethylene glycol monotetradecyl ether, Octyl-beta-D glucopyranoside, Pentaethylene glycol monodecyl ether, Pentaethylene glycol monododecyl ether, Pentaethylene glycol monohexadecyl ether, Pentaethylene glycol monohexyl ether, Pentaethylene glycol monooctadecyl ether, Pentaethylene glycol monooctyl ether, Polyethylene glycol diglycidyl ether, Polyethylene glycol ether W-1, Polyoxyethylene 10 tridecyl ether, Polyoxyethylene 100 stearate, Polyoxyethylene 20 isohexadecyl ether, Polyoxyethylene 20 oleyl ether, Polyoxyethylene 40 stearate, Polyoxyethylene 50 stearate, Polyoxyethylene 8 stearate, Polyoxyethylene bis(imidazolyl carbonyl), Polyoxyethylene 25 propylene glycol stearate, Saponin from *Quillaja* bark, SPAN® 20 sorbitan laurate, SPAN® 40 sorbitan monopalmitate, SPAN® 60 sorbitan stearate, SPAN® 65 sorbitan tristearate, SPAN® 80 sorbitane monooleate, SPAN® 85 sorbitane trioleate, TERGITOL® secondary alcohol ethoxylate Type 15-S-12, TERGITOL® secondary alcohol ethoxylate Type 15-S-30, TERGITOL® secondary alcohol ethoxylate Type 15-S-5, TERGITOL® secondary alcohol ethoxylate Type 15-S-7, TERGITOL® secondary alcohol ethoxylate Type 15-S-9, TERGITOL® nonylphenol ethoxylate Type NP-10, TERGITOL® nonylphenol ethoxylate Type NP-4, TERGITOL® nonylphenol ethoxylate Type NP-40, TERGITOL® nonylphenol ethoxylate Type NP-7, TERGITOL® nonylphenol ethoxylate Type NP-9, TERGITOL® branched secondary alcohol ethoxylate Type TMN-10, TERGITOL® branched secondary alcohol ethoxylate Type TMN-6, TRITON™ X-100 Polyethylene glycol tert-octylphenyl ether or combinations thereof.

The nanoparticles may then be isolated from cellular debris using centrifugation. In embodiments, gradient centrifugation, such as using cesium chloride, sucrose and iodixanol, may be used. Other techniques may be used as alternatives or in addition, such as standard purification techniques including, e.g., ion exchange, affinity, and gel filtration chromatography.

For example, the first column may be an ion exchange chromatography resin, such as FRACTOGEL® EMD methacrylate based polymeric beads TMAE (EMD Millipore), the second column may be a lentil (*Lens culinaris*) lectin affinity resin, and the third column may be a cation exchange column such as a FRACTOGEL® EMD methacrylate based polymeric beads SO3 (EMD Millipore) resin. In other aspects, the cation exchange column may be an MMC column or a Nuvia C Prime column (Bio-Rad Laboratories, Inc). Preferably, the methods disclosed herein do not use a detergent extraction column; for example a hydrophobic interaction column. Such a column is often used to remove detergents during purification but may negatively impact the methods disclosed here.

In embodiments, the first detergent, used to extract the protein from the host cell is substantially replaced with a second detergent to arrive at the nanoparticle structure. In embodiments, the first detergent is NP-9. Typically, the nanoparticles do not contain detectable NP-9 when measured by HPLC. The second detergent is typically selected from the group consisting of PS20, PS40, PS60, PS65, and PS80. In embodiments, the second detergent is PS80.

In embodiments, detergent exchange is performed using affinity chromatography to bind glycoproteins via their carbohydrate moiety. For example, the affinity chromatography may use a legume lectin column. Legume lectins are proteins originally identified in plants and found to interact specifically and reversibly with carbohydrate residues. See, for example, Sharon and Lis, "Legume lectins—a large family of homologous proteins," FASEB J. 1990 November; 4(14):3198-208: Liener, "The Lectins: Properties, Functions, and Applications in Biology and Medicine," Elsevier, 2012. Suitable lectins include concanavalin A (con A), pea lectin, sainfoin lect, and lentil lectin. Lentil lectin is a preferred column for detergent exchange due to its binding properties. Lectin columns are commercially available; for example, Capto Lentil Lectin, is available from GE Healthcare. In certain aspects, the lentil lectin column may use a recombinant lectin. At the molecular level, it is thought that the carbohydrate moieties bind to the lentil lectin, freeing the amino acids of the protein to coalesce around the detergent resulting in the formation of a detergent core providing nanoparticles having multiple copies of the antigen, e.g., glycoprotein oligomers which can be dimers, trimers, or tetramers anchored in the detergent. In embodiments, the CoV S polypeptides and/or hemagglutinins form trimers. In embodiments, the CoV S polypeptide trimers and/or hemagglutinins are anchored in detergent. In embodiments, each nanoparticle contains at least one trimer associated with a non-ionic core.

The detergent, when incubated with the protein to form the nanoparticles during detergent exchange, may be present at up to about 0.1% (w/v) during early purifications steps and this amount is lowered to achieve the final nanoparticles having optimum stability. For example, the non-ionic detergent (e.g., PS80) may be about 0.005% (v/v) to about 0.1% (v/v), for example, about 0.005% (v/v), about 0.006% (v/v), about 0.007% (v/v), about 0.008% (v/v), about 0.009% (v/v), about 0.01% (v/v), about 0.015% (v/v), about 0.02% (v/v), about 0.025% (v/v), about 0.03% (v/v), about 0.035% (v/v), about 0.04% (v/v), about 0.045% (v/v), about 0.05% (v/v), about 0.055% (v/v), about 0.06% (v/v), about 0.065% (v/v), about 0.07% (v/v), about 0.075% (v/v), about 0.08% (v/v), about 0.085% (v/v), about 0.09% (v/v), about 0.095% (v/v), or about 0.1% (v/v) PS80. In embodiments, the nanoparticle contains about 0.03% to about 0.05% PS80. In embodiments, the nanoparticle contains about 0.01% (v/v) PS80.

In embodiments, purified CoV S polypeptides and/or hemagglutinin are dialyzed. In embodiments, dialysis occurs after purification. In embodiments, the CoV S polypeptides and/or hemagglutinin are dialyzed in a solution comprising sodium phosphate, NaCl, and PS80. In embodiments, the dialysis solution comprising sodium phosphate contains between about 5 mM and about 100 mM of sodium phosphate, for example, about 5 mM, about 10 mM, about 15 mM, about 20 mM, about 25 mM, about 30 mM, about 35 mM, about 40 mM, about 45 mM, about 50 mM, about 55 mM, about 60 mM, about 65 mM, about 70 mM, about 75 mM, about 80 mM, about 85 mM, about 90 mM, about 95 mM, or about 100 mM sodium phosphate. In embodiments, the pH of the solution comprising sodium phosphate is about 6.5, about 6.6, about 6.7, about 6.8, about 6.9, about 7.0, about 7.1, about 7.2, about 7.3, about 7.4, or about 7.5. In embodiments, the dialysis solution comprising sodium chloride comprises about 50 mM NaCl to about 500 mM NaCl, for example, about 50 mM, about 60 mM, about 70 mM, about 80 mM, about 90 mM, about 100 mM, about 110 mM, about 120 mM, about 130 mM, about 140 mM, about 150 mM, about 160 mM, about 170 mM, about 180 mM, about 190 mM, about 200 mM, about 210 mM, about 220 mM, about 230 mM, about 240 mM, about 250 mM, about 260 mM, about 270 mM, about 280 mM, about 290 mM, about 300 mM, about 310 mM, about 320 mM, about 330 mM, about 340 mM, about 350 mM, about 360 mM, about 370 mM, about 380 mM, about 390 mM, about 400 mM, about 410 mM, about 420 mM, about 430 mM, about 440 mM, about 450 mM, about 460 mM, about 470 mM, about 480 mM, about 490 mM, or about 500 mM NaCl. In embodiments, the dialysis solution comprising PS80 comprises about 0.005% (v/v), about 0.006% (v/v), about 0.007% (v/v), about 0.008% (v/v), about 0.009% (v/v), about 0.01% (v/v), about 0.015% (v/v), about 0.02% (v/v), about 0.025% (v/v), about 0.03% (v/v), about 0.035% (v/v), about 0.04% (v/v), about 0.045% (v/v), about 0.05% (v/v), about 0.055% (v/v), about 0.06% (v/v), about 0.065% (v/v), about 0.07% (v/v), about 0.075% (v/v), about 0.08% (v/v), about 0.085% (v/v), about 0.09% (v/v), about 0.095% (v/v), or about 0.1% (v/v) PS80. In embodiments, the dialysis solution comprises about 25 mM sodium phosphate (pH 7.2), about 300 mM NaCl, and about 0.01% (v/v) PS80.

Detergent exchange may be performed with proteins purified as discussed above and purified, frozen for storage, and then thawed for detergent exchange.

Stability of compositions disclosed herein may be measured in a variety of ways. In one approach, a peptide map may be prepared to determine the integrity of the antigen protein after various treatments designed to stress the nanoparticles by mimicking harsh storage conditions. Thus, a measure of stability is the relative abundance of antigen peptides in a stressed sample compared to a control sample. For example, the stability of nanoparticles containing the CoV S polypeptides may be evaluated by exposing the nanoparticles to various pHs, proteases, salt, oxidizing agents, including but not limited to hydrogen peroxide, various temperatures, freeze/thaw cycles, and agitation.

(iic) At Least Three Hemagglutinins: An Inactivated Whole Influenza Virus

In embodiments, the at least three hemagglutinins are in the form of a whole influenza virus. A whole influenza virus comprises all of its envelope, viral membrane, nucleocapsid, and genetic material. In embodiments, the whole influenza virus is inactivated as described throughout this disclosure.

(iid) At Least Three Hemagglutinins: Hemagglutinin Composition Extracted from an Influenza Virus In embodiments, the at least three hemagglutinins are in the form of a hemagglutinin composition extracted from an influenza virus. In embodiments, the hemagglutinin composition extracted from an influenza virus is an influenza split-virion composition or a subunit influenza composition.

An influenza split-virion is an influenza virus that has an influenza virus membrane that has been disrupted with a surfactant. In embodiments, the surfactant is any surfactant described herein. In embodiments, the surfactant is sodium taurodeoxycholate, octylphenol ethoxylate (Triton®-X 100), or cetyltrimethyl ammonium bromide. In embodiments, the influenza split-virion is produced using an egg-based or cell-culture based manufacturing method. In embodiments, an influenza split-virion is produced by propagating an influenza virus in Madin Darby Canine Kidney (MDCK) cells, inactivating the virus with β-propiolactone, exposing the virus to the detergent cetyltrimethylammonium bromide, and purifying the virion.

Like an influenza split-virion, a subunit influenza composition is generated by disrupting the influenza virus membrane with a surfactant. However, unlike an influenza split-virion, the subunit influenza composition is subjected to additional purification. In embodiments, the subunit influenza composition is purified by differing sedimentation to remove the internal subviral core. In embodiments, the subunit influenza composition is purified by centrifugation, chromatography, precipitation, or nanofiltration. The surfactant may be any surfactant described herein. In embodiments, the surfactant is sodium taurodeoxycholate, octylphenol ethoxylate (Triton®-X 100), or cetyltrimethyl ammonium bromide. In embodiments, the subunit influenza vaccine is produced using an egg-based or cell-culture based manufacturing method.

In embodiments, a hemagglutinin composition extracted from a virus comprises hemagglutinin and excludes viral ribonucleoprotein (vRNP), the matrix protein M1, and the viral envelope.

In embodiments, a hemagglutinin composition extracted from a virus is obtained by (i) producing a whole influenza virus using an egg-based manufacturing method; (ii) harvesting and clarifying the whole influenza virus by centrifugation and filtration; (iii) inactivating the influenza virus with formaldehyde; (iv) concentrating and purifying the inactivated influenza virus by zonal centrifugation; and (v) centrifuging the inactivated influenza virus in the presence of cetyltrimethylammonium bromide.

Immunogenic Composition Formulations

The disclosure provides immunogenic compositions containing (i) at least three hemagglutinin (HA) glycoproteins, wherein the three HA glycoproteins are from different influenza strains; (ii) a CoV S polypeptide in the form of a detergent-core nanoparticle, wherein the detergent is a non-ionic detergent; and (iii) a pharmaceutically acceptable buffer. In embodiments, the at least three HA glycoproteins are in a form selected from the group consisting of: (a) detergent-core nanoparticles comprising hemagglutinin (HA); (b) HaSMaNs (Hemagglutinin Saponin Matrix Nanoparticles); (c) an influenza split-virion; (d) a whole influenza virus; (e) recombinant hemagglutinin, and (f) a hemagglutinin composition extracted from a virus. In embodiments, the immunogenic composition may contain nanoparticles with antigens from more than one viral strain from the same species of virus.

In embodiments, the immunogenic compositions comprise (i) a CoV S polypeptide in the form of a detergent-core nanoparticle, wherein the detergent is a non-ionic detergent, (ii) at least three hemagglutinin (HA) glycoproteins, wherein the three HA glycoproteins are from different influenza strains, wherein the at least three HA glycoproteins are in the form of detergent-core nanoparticles comprising HA glycoproteins and of HaSMaNs. In embodiments, the immunogenic compositions comprise (i) at least three hemagglutinin (HA) glycoproteins, wherein the three HA glycoproteins are from different influenza strains, wherein the at least three HA glycoproteins are in the form of an influenza split-virion and (ii) a CoV S polypeptide in the form of a detergent-core nanoparticle, wherein the detergent is a non-ionic detergent. In embodiments, the immunogenic compositions comprise (i) at least three hemagglutinin (HA) glycoproteins, wherein the three HA glycoproteins are from different influenza strains, wherein the at least three HA glycoproteins are in the form of a hemagglutinin composition extracted from a virus and (ii) a CoV S polypeptide in the form of a detergent-core nanoparticle, wherein the detergent is a non-ionic detergent.

In embodiments, the compositions comprise a total of between about 1 and about 10 detergent-core nanoparticles comprising hemagglutinin and HaSMaNs, for example, about 1, about 2, about 3, about 4, about 5, about 6, about 7, about 8, about 9, or about 10 total nanoparticles. In embodiments, each detergent-core nanoparticle and HaSMaN contains a hemagglutinin from a different influenza strain. In embodiments, each of the HaSMaNs contains hemagglutinin from a Type A influenza strain. In embodiments, the hemagglutinin from each of the detergent-core nanoparticles is from a Type B influenza strain. In embodiments, each of the HaSMaNs contains hemagglutinin from a Type B influenza strain. In embodiments, the hemagglutinin from each of the detergent-core nanoparticles is from a Type A influenza strain. In embodiments, the hemagglutinin from each of the detergent-core nanoparticles is from a Type B influenza strain and the hemagglutinin from each HaSMaN is from a Type A influenza strain. In embodiments, the compositions comprise a total of four detergent-core nanoparticles comprising hemagglutinin and HaSMaNs. In embodiments, the compositions comprise a total of three detergent-core nanoparticles comprising hemagglutinin and HaSMaNs.

In another embodiment, the disclosures provide for a pharmaceutical pack or kit comprising one or more containers filled with one or more of the components of the immunogenic compositions.

Compositions disclosed herein may be used either prophylactically or therapeutically, but will typically be prophylactic. Accordingly, the disclosure includes methods for treating or preventing infection. The methods involve administering to the subject a therapeutic or prophylactic amount of the immunogenic compositions of the disclosure. In embodiments, the pharmaceutical composition is a vaccine composition that provides a protective effect. In embodiments, the protective effect includes amelioration of a symptom associated with infection in a percentage of the exposed population. For example, the composition may prevent or reduce one or more virus disease symptoms selected from: fever fatigue, muscle pain, headache, sore throat, vomiting, diarrhea, rash, symptoms of impaired kidney and liver function, internal bleeding and external bleeding, compared to an untreated subject.

The nanoparticles may be formulated for administration as vaccines in the presence of various excipients, buffers, and the like. For example, the vaccine compositions may contain sodium phosphate, sodium chloride, and/or histidine. Sodium phosphate may be present at about 10 mM to about 50 mM, about 15 mM to about 25 mM, or about 25 mM; in particular cases, about 22 mM sodium phosphate is present. Histidine may be present about 0.1% (w/v), about 0.5% (w/v), about 0.7% (w/v), about 1% (w/v), about 1.5% (w/v), about 2% (w/v), or about 2.5% (w/v). Sodium chloride, when present, may be about 150 mM. In certain compositions, the sodium chloride may be present in higher concentrations, for example from about 200 mM to about 500 mM. In embodiments, the sodium chloride is present in a high concentration, including but not limited to about 200 mM, about 250 mM, about 300 mM, about 350 mM, about 400 mM, about 450 mM, or about 500 mM.

In embodiments, the nanoparticles described herein have improved stability at certain pH levels. In embodiments, the nanoparticles are stable at slightly acidic pH levels. For example, the nanoparticles that are stable at a slightly acidic pH, for example from pH 5.8 to pH 7.0. In embodiments, the nanoparticles and compositions containing nanoparticles may be stable at pHs ranging from about pH 5.8 to about pH 7.0, including about pH 5.9 to about pH 6.8, about pH 6.0 to about pH 6.5, about pH 6.1 to about pH 6.4, about pH 6.1 to about pH 6.3, or about pH 6.2. In embodiments, the nanoparticles and compositions described herein are stabile at neutral pHs, including from about pH 7.0 to about pH 7.4. In embodiments, the nanoparticles and compositions described herein are stable at slightly alkaline pHs, for example from about pH 7.0 to about pH 8.5, from about pH 7.0 to about pH 8.0, or from about pH 7.0 to about pH 7.5, including all values and ranges in between.

Adjuvants

In certain embodiments, the compositions disclosed herein may be combined with one or more adjuvants to enhance an immune response. In embodiments, the compositions are prepared without adjuvants, and are thus available to be administered as adjuvant-free compositions. Advantageously, adjuvant-free compositions disclosed herein may provide protective immune responses when administered as a single dose. Alum-free compositions that induce robust immune responses are especially useful in adults about 60 and older. In embodiments, the adjuvant is an oil-in-water emulsion composed of squalene as the oil phase, stabilised with the surfactants polysorbate 80 and sorbitan trioleate, in citrate buffer.

Aluminum-Based Adjuvants

In embodiments, the adjuvant may be alum (e.g. $AlPO_4$ or $Al(OH)_3$). Typically, the nanoparticle is substantially bound to the alum. For example, the nanoparticle may be at least 80% bound, at least 85% bound, at least 90% bound or at least 95% bound to the alum. Often, the nanoparticle is 92% to 97% bound to the alum in a composition. The amount of alum is present per dose is typically in a range between about 400 μg to about 1250 μg. For example, the alum may be present in a per dose amount of about 300 μg to about 900 μg, about 400 μg to about 800 μg, about 500 μg to about 700 μg, about 400 μg to about 600 μg, or about 400 μg to about 500 μg. Typically, the alum is present at about 400 μg for a dose of 120 μg of the protein nanoparticle.

Saponin Adjuvants

Adjuvants containing saponin may also be combined with the immunogens disclosed herein. Saponins are glycosides derived from the bark of the *Quillaja saponaria Molina* tree. Typically, saponin is prepared using a multi-step purification process resulting in multiple fractions. As used, herein, the term "a saponin fraction from *Quillaja saponaria Molina*" is used generically to describe a semi-purified or defined saponin fraction of *Quillaja saponaria* or a substantially pure fraction thereof.

Saponin Fractions

Several approaches for producing saponin fractions are suitable. Fractions A, B, and C are described in U.S. Pat. No. 6,352,697 and may be prepared as follows. A lipophilic fraction from Quil A, a crude aqueous *Quillaja saponaria Molina* extract, is separated by chromatography and eluted with 70% acetonitrile in water to recover the lipophilic fraction. This lipophilic fraction is then separated by semi-preparative HPLC with elution using a gradient of from 25% to 60/0 acetonitrile in acidic water. The fraction referred to herein as "Fraction A" or "QH-A" is, or corresponds to, the fraction, which is eluted at approximately 39% acetonitrile. The fraction referred to herein as "Fraction B" or "QH-B" is, or corresponds to, the fraction, which is eluted at approximately 47% acetonitrile. The fraction referred to herein as "Fraction C" or "QH-C" is, or corresponds to, the fraction, which is eluted at approximately 49/6 acetonitrile. Additional information regarding purification of Fractions is found in U.S. Pat. No. 5,057,540. When prepared as described herein, Fractions A, B and C of *Quillaja saponaria Molina* each represent groups or families of chemically closely related molecules with definable properties. The chromatographic conditions under which they are obtained are such that the batch-to-batch reproducibility in terms of elution profile and biological activity is highly consistent.

Other saponin fractions have been described. Fractions B3, B4 and B4b are described in EP 0436620. Fractions QA1-QA22 are described EP03632279 B2, Q-VAC (Nor-Feed, AS Denmark), *Quillaja saponaria Molina* Spikoside (lsconova AB, Ultunaallèn 2B, 756 51 Uppsala, Sweden). Fractions QA-1, QA-2, QA-3, QA-4, QA-5, QA-6, QA-7, QA-8, QA-9, QA-10, QA-11, QA-12, QA-13, QA-14, QA-15, QA-16, QA-17, QA-18, QA-19, QA-20, QA-21, and QA-22 of EP 0 3632 279 B2, especially QA-7, QA-17, QA-18, and QA-21 may be used. They are obtained as described in EP 0 3632 279 B2, especially at page 6 and in Example 1 on page 8 and 9.

The saponin fractions described herein and used for forming adjuvants are often substantially pure fractions; that is, the fractions are substantially free of the presence of contamination from other materials. In particular aspects, a substantially pure saponin fraction may contain up to 40% by weight, up to 30% by weight, up to 25% by weight, up to 20% by weight, up to 15% by weight, up to 10% by weight, up to 7% by weight, up to 5% by weight, up to 2% by weight, up to 1% by weight, up to 0.5% by weight, or up to 0.1% by weight of other compounds such as other saponins or other adjuvant materials.

ISCOM Structures

Saponin fractions may be administered in the form of a cage-like particle referred to as an ISCOM (Immune Stimulating COMplex). ISCOMs may be prepared as described in EP0109942B1, EP0242380B1 and EP0180546 B1. In particular embodiments a transport and/or a passenger antigen may be used, as described in EP 9600647-3 (PCT/SE97/00289).

Matrix Adjuvants

In embodiments, the ISCOM is an ISCOM matrix complex. An ISCOM matrix complex comprises at least one saponin fraction and a lipid. The lipid is at least a sterol, such as cholesterol. In particular aspects, the ISCOM matrix complex also contains a phospholipid. The ISCOM matrix complexes may also contain one or more other immunomodulatory (adjuvant-active) substances, not necessarily a glycoside, and may be produced as described in EP0436620B1, which is incorporated by reference in its entirety herein.

In other aspects, the ISCOM is an ISCOM complex. An ISCOM complex contains at least one saponin, at least one lipid, and at least one kind of antigen or epitope. The ISCOM complex contains antigen associated by detergent treatment such that that a portion of the antigen integrates into the particle. In contrast, ISCOM matrix is formulated as an admixture with antigen and the association between ISCOM matrix particles and antigen is mediated by electrostatic and/or hydrophobic interactions.

According to one embodiment, the saponin fraction integrated into an ISCOM matrix complex or an ISCOM complex, or at least one additional adjuvant, which also is integrated into the ISCOM or ISCOM matrix complex or mixed therewith, is selected from fraction A, fraction B, or fraction C of *Quillaja saponaria*, a semipurified preparation of *Quillaja saponaria*, a purified preparation of *Quillaja saponaria*, or any purified sub-fraction e.g., QA 1-21.

In particular aspects, each ISCOM particle may contain at least two saponin fractions. Any combinations of weight % of different saponin fractions may be used. Any combination of weight % of any two fractions may be used. For example, the particle may contain any weight % of fraction A and any weight % of another saponin fraction, such as a crude saponin fraction or fraction C, respectively. Accordingly, in particular aspects, each ISCOM matrix particle or each ISCOM complex particle may contain from 0.1 to 99.9 by weight, 5 to 95% by weight, 10 to 90% by weight 15 to 85% by weight, 20 to 80% by weight, 25 to 75% by weight, 30 to 70% by weight, 35 to 65% by weight, 40 to 60% by weight, 45 to 55% by weight, 40 to 60% by weight, or 50% by weight of one saponin fraction, e.g. fraction A and the rest up to 100% in each case of another saponin e.g. any crude fraction or any other faction e.g. fraction C. The weight is calculated as the total weight of the saponin fractions. Examples of ISCOM matrix complex and ISCOM complex adjuvants are disclosed in U.S Published Application No. 2013/0129770, which is incorporated by reference in its entirety herein.

In particular embodiments, the ISCOM matrix or ISCOM complex comprises from 5-99% by weight of one fraction, e.g. fraction A and the rest up to 100% of weight of another fraction e.g. a crude saponin fraction or fraction C. The weight is calculated as the total weight of the saponin fractions.

In another embodiment, the ISCOM matrix or ISCOM complex comprises from 40% to 99% by weight of one fraction, e.g. fraction A and from 1% to 60% by weight of another fraction, e.g. a crude saponin fraction or fraction C. The weight is calculated as the total weight of the saponin fractions.

In yet another embodiment, the ISCOM matrix or ISCOM complex comprises from 70% to 95% by weight of one fraction e.g., fraction A, and from 30% to 5% by weight of another fraction, e.g., a crude saponin fraction, or fraction C. The weight is calculated as the total weight of the saponin fractions. In other embodiments, the saponin fraction from *Quillaja saponaria Molina* is selected from any one of QA 1-21.

In addition to particles containing mixtures of saponin fractions, ISCOM matrix particles and ISCOM complex particles may each be formed using only one saponin fraction. Compositions disclosed herein may contain multiple particles wherein each particle contains only one saponin fraction. That is, certain compositions may contain one or more different types of ISCOM-matrix complexes particles and/or one or more different types of ISCOM complexes particles, where each individual particle contains one saponin fraction from *Quillaja saponaria Molina*, wherein the saponin fraction in one complex is different from the saponin fraction in the other complex particles.

In particular aspects, one type of saponin fraction or a crude saponin fraction may be integrated into one ISCOM matrix complex or particle and another type of substantially pure saponin fraction, or a crude saponin fraction, may be integrated into another ISCOM matrix complex or particle. A composition or vaccine may comprise at least two types of complexes or particles each type having one type of saponins integrated into physically different particles.

In the compositions, mixtures of ISCOM matrix complex particles and/or ISCOM complex particles may be used in which one saponin fraction *Quillaja saponaria Molina* and another saponin fraction *Quillaja saponaria Molina* are separately incorporated into different ISCOM matrix complex particles and/or ISCOM complex particles.

The ISCOM matrix or ISCOM complex particles, which each have one saponin fraction, may be present in composition at any combination of weight %. In particular aspects, a composition may contain 0.1% to 99.9% by weight, 5% to 95% by weight, 10% to 90% by weight, 15% to 85% by weight, 20% to 80% by weight, 25% to 75% by weight, 30% to 70% by weight, 35% to 65% by weight, 40% to 60% by weight, 45% to 55% by weight, 40 to 60% by weight, or 50% by weight, of an ISCOM matrix or complex containing a first saponin fraction with the remaining portion made up by an ISCOM matrix or complex containing a different saponin fraction. In aspects, the remaining portion is one or more ISCOM matrix or complexes where each matrix or complex particle contains only one saponin fraction. In other aspects, the ISCOM matrix or complex particles may contain more than one saponin fraction.

In particular compositions, the only saponin fraction in a first ISCOM matrix or ISCOM complex particle is Fraction A and the only saponin fraction in a second ISCOM matrix or ISCOM complex particle is Fraction C.

Preferred compositions comprise a first ISCOM matrix containing Fraction A and a second ISCOM matrix containing Fraction C, wherein the Fraction A ISCOM matrix constitutes about 70% per weight of the total saponin adjuvant, and the Fraction C ISCOM matrix constitutes about 30/per weight of the total saponin adjuvant. In another preferred composition, the Fraction A ISCOM matrix constitutes about 85% per weight of the total saponin adjuvant, and the Fraction C ISCOM matrix constitutes about 15% per weight of the total saponin adjuvant. Thus, in certain compositions, the Fraction A ISCOM matrix is present in a range of about 70% to about 85%, and Fraction C ISCOM matrix is present in a range of about 15% to about 30%, of the total weight amount of saponin adjuvant in the composition. In embodiments, the Fraction A ISCOM matrix accounts for 50-96% by weight and Fraction C ISCOM matrix accounts for the remainder, respectively, of the sums of the weights of Fraction A ISCOM matrix and Fraction C ISCOM in the adjuvant. In a particularly preferred composition, referred to herein as MATRIX-Mm, the Fraction A ISCOM matrix is present at about 85% and Fraction C ISCOM matrix is present at about 15% of the total weight amount of saponin adjuvant in the composition. MATRIX-Mm may be referred to interchangeably as Matrix-M1.

Exemplary QS-7 and QS-21 fractions, their production and their use is described in U.S. Pat. Nos. 5,057,540; 6,231,859; 6,352,697; 6,524,584; 6,846,489; 7,776,343, and 8,173,141, which are incorporated by reference herein.

In embodiments, other adjuvants may be used in addition or as an alternative. The inclusion of any adjuvant described in Vogel et al., "A Compendium of Vaccine Adjuvants and Excipients (2nd Edition)," herein incorporated by reference in its entirety for all purposes, is envisioned within the scope of this disclosure. Other adjuvants include complete Freund's adjuvant (a non-specific stimulator of the immune response containing killed *Mycobacterium tuberculosis*), incomplete Freund's adjuvants and aluminum hydroxide adjuvant. Other adjuvants comprise GMCSP, BCG, MDP compounds, such as thur-MDP and nor-MDP, CGP (MTP-PE), lipid A, and monophosphoryl lipid A (MPL), MF-59, RIBI, which contains three components extracted from bacteria, MPL, trehalose dimycolate (TDM) and cell wall skeleton (CWS) in a 2% squalene/TWEEN® polysorbate 80 emulsion. In embodiments, the adjuvant may be a paucilamellar lipid vesicle; for example, NOVASOMES®. NOVASOMES® are paucilamellar nonphospholipid vesicles ranging from about 100 nm to about 500 nm. They comprise BRIJ® alcohol ethoxylate 72, cholesterol, oleic acid and squalene. NOVASOMES® have been shown to be an effective adjuvant (see, U.S. Pat. Nos. 5,629,021, 6,387,373, and 4,911,928.

Administration and Dosage

In embodiments, the disclosure provides a method for eliciting an immune response against one or more coronaviruses and/or influenza viruses. In embodiments, the response is against one or more of the SARS-CoV-2 virus, MERS, and SARS. In embodiments, the response is against a heterogeneous SARS-CoV-2 strain. Non-limiting examples of heterogeneous SARS-CoV-2 strains include the Ca1.20C SARS-CoV-2 strain, P.1 SARS-CoV-2 strain, B.1.351 SARS-CoV-2 strain, and B.1.1.7 SARS-CoV-2 strain. The method involves administering an immunologically effective amount of an immunogenic composition described herein to a subject. Advantageously, the proteins disclosed herein induce one or more of particularly useful anti-coronavirus and/or anti-influenza responses.

In embodiments, the compositions described herein are administered with an adjuvant. In embodiments, the compositions described herein are administered without an adjuvant. In aspects, the adjuvant may be bound to the nanoparticle, such as by a non-covalent interaction. In other aspects, the adjuvant is co-administered with the nanoparticle but the adjuvant and nanoparticle do not interact substantially.

In embodiments, the compositions may be used for the prevention and/or treatment of one or more of a SARS-CoV-2 infection, a heterogeneous SARS-CoV-2 strain infection, a SARS infection, a MERS infection, and influenza infection, or a combination thereof. Thus, the disclosure provides a method for eliciting an immune response against one or more of the SARS-CoV-2 virus, heterogeneous SARS-CoV-2 virus, MERS, SARS, and an influenza virus. The method involves administering an immunologically effective amount of a composition described herein to a subject. Advantageously, the compositions disclosed herein induce particularly useful anti-coronavirus and/or anti-influenza responses.

In embodiments, the compositions described herein have an efficacy against a SARS-CoV-2 virus or a heterogeneous SARS-CoV-2 strain that is between about 50% and about 99%, between about 80% and about 99%, between about 75% and about 99%, between about 80% and about 95%, between about 90% and about 98%, between about 75% and about 95%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%. In embodiments, the nanoparticles or CoV S polypeptides described herein have an efficacy against a Ca1.20C SARS-CoV-2 strain that is between about 50% and about 99%, between about 80% and about 99%, between about 75% and about 99%, between about 80% and about 95%, between about 90% and about 98%, between about 75% and about 95%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%. In embodiments, the nanoparticles or CoV S polypeptides described herein have an efficacy against a P.1 SARS-CoV-2 strain that is between about 50% and about 99%, between about 80% and about 99%, between about 75% and about 99%, between about 80% and about 95%, between about 90% and about 98%, between about 75% and about 95%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%. In embodiments, the nanoparticles or CoV S polypeptides described herein have an efficacy against a B.1.351 SARS-CoV-2 strain that is between about 50% and about 99%, between about 80% and about 99%, between about 75% and about 99%, between about 80% and about 95%, between about 90% and about 98%, between about 75% and about 95%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%. In embodiments, the nanoparticles or CoV S polypeptides described herein have an efficacy against a B.1.1.7 SARS-CoV-2 strain that is between about 50% and about 99%, between about 80% and about 99%, between about 75% and about 99%, between about 80% and about 95%, between about 90% and about 98%, between about 75% and about 95%, at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99%.

In embodiments, the immunogenicity of a composition described herein against an influenza virus is determined using a HAI assay or by measuring neutralizing antibodies. The method for performing an HAI assay is described in the following article which is incorporated by reference herein in its entirety: Cowling et al. Clin Infect Dis. 2019; 68(10): 1713-1717. In embodiments, the immunogenicity of the nanoparticle influenza vaccines may be compared to a commercially available influenza vaccine composition. As used herein, "commercially available influenza vaccine composition" can be any influenza vaccine composition that is available for medical use. For example, the commercially available influenza vaccine composition can be formulated for a trivalent or a quadrivalent injection. In embodiments aspects, the formulation for an injection can comprise the inactivated form of the virus. In embodiments, the commercially available influenza vaccine composition can be formulated for a nasal spray. In embodiments, the formulation for a nasal spray can comprise attenuated or weakened forms of the virus. In embodiments, the compositions disclosed herein induce neutralizing antibodies that bind to an influenza strain that has drifted (i.e. undergone slight mutation) relative to the sequence used in the virus within the same sub-type of influenza. In embodiments, one, two, three four, or all of the strains used in the compositions induce neutralizing antibodies against one drifted strain, against two drifted strains, against three drifted strains, against four drifted strains, or against five drifted strains.

Compositions disclosed herein may be administered via a systemic route or a mucosal route or a transdermal route or directly into a specific tissue. As used herein, the term "systemic administration" includes parenteral routes of administration. In particular, parenteral administration includes subcutaneous, intraperitoneal, intravenous, intraarterial, intramuscular, or intrasternal injection, intravenous, or kidney dialytic infusion techniques. Typically, the systemic, parenteral administration is intramuscular injection. As used herein, the term "mucosal administration" includes oral, intranasal, intravaginal, intra-rectal, intra-tracheal, intestinal and ophthalmic administration. Preferably, administration is intramuscular.

Compositions may be administered on a single dose schedule or a multiple dose schedule. Multiple doses may be used in a primary immunization schedule or in a booster immunization schedule. In a multiple dose schedule the various doses may be given by the same or different routes e.g., a parenteral prime and mucosal boost, a mucosal prime and parenteral boost, etc. In aspects, a follow-on boost dose is administered about 2 weeks, about 3 weeks, about 4 weeks, about 5 weeks, or about 6 weeks after the prior dose. In embodiments, the follow-on boost dose is administered 3 weeks after administration of the prior dose. In embodiments, the first dose is administered at day 0, and the boost dose is administered at day 21. In embodiments, the first dose is administered at day 0, and the boost dose is administered at day 28.

In embodiments, the dose, as measured in μg, may be the total weight of the dose including the solute, or the weight of the nanoparticles, or the weight of a protein in a nanoparticle (e.g., the weight of hemagglutinin or a CoV S polypeptide). Dose is measured using protein concentration assay either A280 or ELISA.

The dose of CoV S polypeptide, including for pediatric administration, may be in the range of about 1 μg to about 25 μg, about 3 μg to about 25 μg, about 5 μg to about 25 μg, about 5 μg to about 50 μg, about 1 μg to about 300 μg, about 90 μg to about 270 μg, about 100 μg to about 160 μg, about 110 μg to about 150 μg, about 120 μg to about 140 μg, or about 140 μg to about 160 μg. In embodiments, the dose is about 120 μg, administered with alum. In aspects, dose ranges from about 1 μg to about 90 μg. In embodiments, the dose of CoV Spike (S) polypeptide is about 1 μg, about 2 μg, about 3 μg, about 4 μg, about 5 μg, about 6 μg, about 7 μg, about 8 μg, about 9 μg, about 10 μg, about 11 μg, about 12 μg, about 13 μg, about 14 μg, about 15 μg, about 16 μg, about 17 μg, about 18 μg, about 19 μg, about 20 μg, about 21, about 22, about 23, about 24, about 25 μg, about 26 μg, about 27 μg, about 28 μg, about 29 μg, about 30 μg, about 40 μg, about 50, about 60, about 70, about 80, about 90 about 100 μg, about 110 μg, about 120 μg, about 130 μg, about 140 μg, about 150 μg, about 160 μg, about 170 μg, about 180 μg, about 190 μg, about 200 μg, about 210 μg, about 220 μg, about 230 μg, about 240 μg, about 250 μg, about 260 μg, about 270 μg, about 280 μg, about 290 μg, or about 300 μg, including all values and ranges in between. In embodiments, the dose of CoV S polypeptide is about 3 μg. In embodiments, the dose of CoV S polypeptide is about 5 μg. In embodiments, the dose of CoV S polypeptide is about 25 μg. In embodiments, the dose of CoV S polypeptide is about 20 μg.

The total amount of the hemagglutinin in the immunogenic compositions may range from about 25 μg to about 200 μg, about 30 μg to about 150 μg, about 50 μg to about 100 μg, about 45 μg to about 180 μg, about 60 μg to about 190 μg, or about 100 μg to about 200 μg. In certain embodiments, the amount of the influenza HA protein in the immunogenic composition may be in the range of about 5 μg per strain to about 80 μg per strain, about 10 μg per strain to about 75 μg per strain, about 15 μg per strain to about 70 μg per strain, about 20 μg per strain to about 65 μg per strain, about 25 μg per strain to about 60 μg per strain, about 30 μg per strain to about 55 μg per strain, about 35 μg per strain to about 50 μg per strain, about 15 μg per strain to about 60 μg per strain. A dose per strain, for example, 10 μg per strain, refers to a dose of a hemagglutinin from a particular strain of influenza. In embodiments, a subject is administered an immunogenic composition comprising between about 5 μg and about 100 μg of hemagglutinin per strain. For example, in embodiments, the compositions comprise about 5 μg, about 6 μg, about 7 μg, about 7.5 μg, about 8 μg, about 9 μg, about 10 μg, about 11 μg, about 12 μg, about 13 μg, about 14 μg, about 15 μg, about 16 μg, about 17 μg, about 18 μg, about 19 μg, about 20 μg, about 21, about 22, about 23, about 24, about 25 μg, about 26 μg, about 27 μg, about 28 μg, about 29 μg, about 30 μg, about 31 μg, about 32 μg, about 33 μg, about 34 μg, about 35 μg, about 36 μg, about 37 μg, about 38 μg, about 39 μg, about 40 μg, about 41 μg, about 42 μg, about 43 μg, about 44 μg, about 45 μg, about 46 μg, about 47 μg, about 48 μg, about 49 μg, about 50 μg, about 51 μg, about 52 μg, about 53 μg, about 54 μg, about 55 μg, about 56 μg, about 57 μg, about 58 μg, about 59 μg, about 60 μg, about 61 μg, about 62 μg, about 63 μg, about 64 μg, about 65 μg, about 66 μg, about 67 μg, about 68 μg, about 69 μg, about 70 μg, about 71 μg, about 72 μg, about 73 μg, about 74 μg, about 75 μg, about 76 μg, about 77 μg, about 78 μg, about 79 μg, about 80 μg, about 81 μg, about 82 μg, about 83 μg, about 84 μg, about 85 μg, about 86 μg, about 87 μg, about 88 μg, about 89 μg, about 90 μg, about 91 μg, about 92 μg, about 93 μg, about 94 μg, about 95 μg, about 96 μg, about 97 μg, about 98 μg, about 99 μg, or about 100 μg of hemagglutinin per strain. In embodiments, the composition comprises from 24 μg to 40 μg hemagglutinin per strain.

In embodiments, a patient is administered an immunogenic composition containing from about 5 to 60 μg hemagglutinin per strain and from about 2.5 to 22.5 μg of CoV S polypeptide. In embodiments, the composition comprises from about 24 μg to 40 μg hemagglutinin per strain and from 5 μg to about 25 μg of CoV S polypeptide. In embodiments, the immunogenic composition contains 5, 10, 35, or 60 μg hemagglutinin per strain. In embodiments, the immunogenic composition contains 2.5, 7.5, or 22.5 μg of CoV S polypeptide. In embodiments, the immunogenic composition contains hemagglutinin from three or four strains of influenza. In embodiments, the immunogenic composition contains about 40 μg of a saponin adjuvant, e.g., MATRIX-M™. In embodiments, the immunogenic composition contains about 50 μg of a saponin adjuvant, e.g., MATRIX-M™. In embodiments, the dose of hemagglutinin per strain and the dose of CoV S polypeptide is found in Table 1H.

In embodiments, a patient is administered a boost dose of an immunogenic composition 49, 50, 51, 52, 53, 54, 55, 56, 57, 58, 59, 60, or 61 days after initial administration of the immunogenic composition. In embodiments, a patient is administered a boost dose of the immunogenic composition 56 days after initial administration of the immunogenic composition. In embodiments, a patient is administered a boost dose of the immunogenic composition 56 days (+5 days) after initial administration of the immunogenic composition. In embodiments, the boost dose contains the same amount of hemagglutinin per strain and CoV S polypeptide as the initial dose. In embodiments, the boost dose contains a different amount of hemagglutinin per strain, CoV S polypeptide, or a combination thereof, than the initial dose. In embodiments, the amount of hemagglutinin per strain and the amount of CoV S polypeptide in the boost dose of the immunogenic composition is selected from Table 1H.

TABLE 1H

| Option | Hemagglutinin per strain (μg) | CoV S polypeptide (μg) |
|---|---|---|
| A | 60 | 22.5 |
| B | 10 | 2.5 |
| C | 60 | 22.5 |
| D | 60 | 7.5 |
| E | 10 | 22.5 |
| F | 35 | 7.5 |
| G | 5 | 22.5 |
| H | 60 | 2.5 |

TABLE 1H-continued

| Option | Hemagglutinin per strain (μg) | CoV S polypeptide (μg) |
|---|---|---|
| I | 5 | 7.5 |
| J | 5 | 2.5 |
| K | 35 | 22.5 |
| L | 35 | 2.5 |
| M | 60 | 7.5 |
| N | 60 | 2.5 |
| O | 24 | 25 |
| P | 25 | 25 |
| Q | 26 | 25 |
| R | 27 | 25 |
| S | 28 | 25 |
| T | 29 | 25 |
| U | 30 | 25 |
| V | 31 | 25 |
| W | 32 | 25 |
| X | 33 | 25 |
| Y | 34 | 25 |
| Z | 35 | 25 |
| AA | 36 | 25 |
| AB | 37 | 25 |
| AC | 38 | 25 |
| AD | 39 | 25 |
| AE | 40 | 25 |

In embodiments, a patient is administered a first immunogenic composition containing from about 5 to 60 μg hemagglutinin per strain and a second immunogenic composition containing from about 2.5 to about 22.5 μg of CoV S polypeptide. In embodiments, the first immunogenic composition contains about 5, about 10, about 35, or about 60 μg hemagglutinin per strain. In embodiments, the second immunogenic composition contains about 2.5 μg, about 7.5 μg, about 22.5 μg, or about 25 μg of CoV S polypeptide. In embodiments, the first immunogenic composition contains hemagglutinin from three or four strains of influenza. In embodiments, the amount of hemagglutinin per strain in the first immunogenic composition and the amount of CoV S polypeptide in the second immunogenic composition is provided in Table 1H. In embodiments, the first immunogenic composition, second immunogenic composition, or both contain about 50 μg of a saponin adjuvant, e.g., MATRIX-M™. In embodiments, a patient is administered a boost dose of the first immunogenic composition, second immunogenic composition, or both, 49, 50, 51, 52, 53, 54, 55, 56, 57, 58, 59, 60, or 61 days after initial administration of the first immunogenic composition, second immunogenic composition, or both. In embodiments, a patient is administered a boost dose of the immunogenic composition 56 days after initial administration of the first immunogenic composition, second immunogenic composition, or both. In embodiments, a patient is administered a boost dose of the immunogenic composition 56 days (+5 days) after initial administration of the first immunogenic composition, second immunogenic composition, or both. In embodiments, the boost dose contains the same amount of hemagglutinin per strain and CoV S polypeptide as the initial dose. In embodiments, the boost dose contains a different amount of hemagglutinin per strain, CoV S polypeptide, or a combination thereof, than the initial dose. In embodiments, the amount of hemagglutinin per strain and the amount of CoV S polypeptide in the boost dose of the first or second immunogenic composition is selected from Table 1H. Certain populations may be administered with or without adjuvants. In certain aspects, compositions may be free of added adjuvant. In such circumstances, the dose may be increased by about 10%.

In embodiments, a patient is administered from about 24 μg to about 40 μg hemagglutinin per strain and a CoV S polypeptide dose of greater than about 20 μg. In embodiments, a patient is administered 24-40 μg hemagglutinin per strain and a CoV S polypeptide dose of about 25 μg.

In embodiments, the dose of the adjuvant is from about 1 μg to about 100 μg, for example, about 1 μg, about 2 μg, about 3 μg, about 4 μg, about 5 μg, about 6 μg, about 7 μg, about 8 μg, about 9 μg, about 10 μg, about 11 μg, about 12 μg, about 13 μg, about 14 μg, about 15 μg, about 16 μg, about 17 μg, about 18 μg, about 19 μg, about 20 μg, about 21, about 22, about 23, about 24, about 25 μg, about 26 μg, about 27 μg, about 28 μg, about 29 μg, about 30 μg, about 31 μg, about 32 μg, about 33 μg, about 34 μg, about 35 μg, about 36 μg, about 37 μg, about 38 μg, about 39 μg, about 40 μg, about 41 μg, about 42 μg, about 43 μg, about 44 μg, about 45 μg, about 46 μg, about 47 μg, about 48 μg, about 49 μg, about 50 μg, about 51 μg, about 52 μg, about 53 μg, about 54 μg, about 55 μg, about 56 μg, about 57 μg, about 58 μg, about 59 μg, about 60 μg, about 61 μg, about 62 μg, about 63 μg, about 64 μg, about 65 μg, about 66 μg, about 67 μg, about 68 μg, about 69 μg, about 70 μg, about 71 μg, about 72 μg, about 73 μg, about 74 μg, about 75 μg, about 76 μg, about 77 μg, about 78 μg, about 79 μg, about 80 μg, about 81 μg, about 82 μg, about 83 μg, about 84 μg, about 85 μg, about 86 μg, about 87 μg, about 88 μg, about 89 μg, about 90 μg, about 91 μg, about 92 μg, about 93 μg, about 94 μg, about 95 μg, about 96 μg, about 97 μg, about 98 μg, about 99 μg, or about 100 μg of adjuvant. In embodiments, the dose of adjuvant is about 50 μg. In embodiments, the adjuvant is a saponin adjuvant, e.g., MATRIX-Mm In embodiments, the dose is administered in a volume of about 0.1 mL to about 1.5 mL, for example, about 0.1 mL, about 0.2 mL, about 0.25 mL, about 0.3 mL, about 0.4 mL, about 0.5 mL, about 0.6 mL, about 0.7 mL, about 0.8 mL, about 0.9 mL, about 1.0 mL, about 1.1 mL, about 1.2 mL, about 1.3 mL, about 1.4 mL, or about 1.5 mL. In embodiments, the dose is administered in a volume of 0.25 mL. In embodiments, the dose is administered in a volume of 0.5 mL. In embodiments, the dose is administered in a volume of 0.6 mL.

In embodiments, the dose may comprise a CoV S polypeptide or hemagglutinin concentration of about 1 μg/mL to about 50 μg/mL, 10 μg/mL to about 100 μg/mL, about 10 μg/mL to about 50 μg/mL, about 175 μg/mL to about 325 μg/mL, about 200 μg/mL to about 300 μg/mL, about 220 μg/mL to about 280 μg/mL, or about 240 μg/mL to about 260 μg/mL.

In embodiments, the immunogenic compositions described herein are administered in combination with an additional immunogenic composition. In embodiments, the additional immunogenic composition induces an immune response against SARS-CoV-2. In embodiments, the additional immunogenic composition is administered within about 1 minute, about 5 minutes, about 10 minutes, about 20 minutes, about 30 minutes, about 40 minutes, about 50 minutes, about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 1 day, about 2 days, about 3 days, about 4 days, about 5 days, about 6 days, about 7 days, about 8 days, about 9 days, about 10 days, about 11 days, about 12 days, about 13 days, about 14 days, about 15 days, about 16 days, about 17 days, about 18 days, about 19 days, about 20 days, about 21 days, about 22 days, about 23 days, about 24 days, about 25 days, about 26 days, about 27 days, about 28 days, about 29 days, about 30 days, or about 31 days of the disclosed immunogenic compositions. In embodiments, the additional composition is administered with a first dose of a composition described herein. In embodiments, the additional composition is administered with a boost dose of a composition comprising CoV S polypeptides or nanoparticles, detergent-core nanoparticles, HaSMaNs, or combinations thereof. In embodiments, the additional composition is administered with a (a) first immunogenic composition comprising (i) a CoV S glycoprotein the form of a detergent-core nanoparticle, wherein the detergent is a non-ionic detergent and (ii) a pharmaceutically acceptable buffer and (b) a second immunogenic composition comprising (i) at least three HA glycoproteins, wherein each HA glycoprotein is from a different influenza strain and (ii) a pharmaceutically acceptable buffer. In embodiments, the additional composition is administered with an initial dose of a first immunogenic composition and/or second immunogenic composition. In embodiments, the additional composition is administered with an boost dose of a first immunogenic composition and/or second immunogenic composition.

In embodiments, provided herein is a method for eliciting an immune response against one or more coronaviruses and/or influenza viruses comprising administering an immunogenic composition described herein. In embodiments, provided herein is a method for eliciting an immune response against one or more coronaviruses and/or influenza viruses comprising (a) administering a first immunogenic composition comprising (i) a CoV S glycoprotein the form of a detergent-core nanoparticle, wherein the detergent is a non-ionic detergent and (ii) a pharmaceutically acceptable buffer and (b) administering a second immunogenic composition comprising (i) at least three HA glycoproteins, wherein each HA glycoprotein is from a different influenza strain and (ii) a pharmaceutically acceptable buffer. In embodiments, the first immunogenic composition is administering about 20 minutes, about 30 minutes, about 40 minutes, about 50 minutes, about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 1 day before the second immunogenic composition. In embodiments, the first immunogenic composition is administering about 20 minutes, about 30 minutes, about 40 minutes, about 50 minutes, about 1 hour, about 2 hours, about 3 hours, about 4 hours, about 5 hours, about 6 hours, about 7 hours, about 8 hours, about 9 hours, about 10 hours, about 11 hours, about 12 hours, about 13 hours, about 14 hours, about 15 hours, about 16 hours, about 17 hours, about 18 hours, about 19 hours, about 20 hours, about 21 hours, about 22 hours, about 23 hours, about 1 day after the second immunogenic composition. Typically, the first immunogenic composition and second immunogenic composition are administered at the same time (i.e., within 15 minutes of each other). In embodiments, the first immunogenic composition is administered intramuscularly. In embodiments, the second immunogenic composition is administered intramuscularly. In embodiments, the second immunogenic composition is administered intranasally. In embodiments, the first immunogenic composition is administered intramuscularly and the second immunogenic composition is administered intramuscularly. In embodiments, the first immunogenic composition is administered intramuscularly and the second immunogenic composition is administered intranasally. In embodiments, the first immunogenic composition and second immunogenic composition are administered intramuscularly to the same arm. In embodiments, the first immunogenic composition and second immunogenic composition are administered intramuscularly to different arms.

In embodiments, the additional immunogenic composition comprises an mRNA encoding a SARS-Cov-2 Spike glycoprotein, a plasmid DNA encoding a SARS-Cov-2 Spike glycoprotein, an viral vector encoding a SARS-Cov-2 Spike glycoprotein, or an inactivated SARS-CoV-2 virus.

In embodiments, the additional immunogenic composition comprises mRNA that encodes for a CoV S polypeptide. In embodiments, the mRNA encodes for a CoV S polypeptide comprising proline substitutions at positions 986 and 987 of SEQ ID NO: 1. In embodiments, the mRNA encodes for a CoV S polypeptide comprising an intact furin cleavage site. In embodiments, the mRNA encodes for a CoV S polypeptide comprising proline substitutions at positions 986 and 987 of SEQ ID NO: 1 and an intact furin cleavage site. In embodiments, the mRNA encodes for a CoV S polypeptide comprising proline substitutions at positions 986 and 987 of SEQ ID NO: 1 and an inactive furin cleavage site. In embodiments, the mRNA encodes for a CoV S polypeptide having an amino acid sequence of SEQ ID NO: 87. In embodiments, the mRNA encoding for a CoV S polypeptide is encapsulated in a lipid nanoparticle. An exemplary immunogenic composition comprising mRNA that encodes for a CoV S polypeptide is described in Jackson et al. N. Eng. J. Med. 2020. An mRNA Vaccine against SARS-CoV-2- preliminary report, which is incorporated by reference in its entirety herein. In embodiments, the composition comprising mRNA that encodes for a CoV S polypeptide is administered at a dose of 25 μg, 100 μg, or 250 μg.

In embodiments, the additional immunogenic composition comprises an adenovirus vector encoding for a CoV S polypeptide. In embodiments, the AAV vector encodes for a wild-type CoV S polypeptide. In embodiments, the AAV vector encodes for a CoV S polypeptide comprising proline substitutions at positions 986 and 987 of SEQ ID NO: 1 and an intact furin cleavage site. In embodiments, the AAV vector encodes for a CoV S polypeptide comprising proline substitutions at positions 986 and 987 of SEQ ID NO: 1 and an inactive furin cleavage site. In embodiments, the AAV vector encodes for a CoV S polypeptide having an amino acid sequence of SEQ ID NO: 87. The following publications describe immunogenic compositions comprising an adenovirus vector encoding for a CoV S polypeptide, each of which is incorporated by reference in its entirety herein: van Doremalen N. et al. A single dose of ChAdOx1 MERS provides protective immunity in rhesus macaques. Science Advances, 2020; van Doremalen N. et al. ChAdOx1 nCoV-19 vaccination prevents SARS-CoV-2 pneumonia in rhesus macaques. bioRxiv, (2020).

In embodiments, the additional immunogenic composition comprises deoxyribonucleic acid (DNA). In embodiments, the additional immunogenic composition comprises plasmid DNA. In embodiments, the plasmid DNA encodes for a CoV S polypeptide. In embodiments, the DNA encodes for a CoV S polypeptide comprising proline substitutions at positions 986 and 987 of SEQ ID NO: 1 and an intact furin cleavage site. In embodiments, the DNA encodes for a CoV S polypeptide comprising proline substitutions at positions 986 and 987 of SEQ ID NO: 1 and an inactive furin cleavage site. In embodiments, the DNA encodes for a CoV S polypeptide having an amino acid sequence of SEQ ID NO: 87.

In embodiments, the additional immunogenic composition comprises an inactivated virus vaccine.

In embodiments, the immunogenic compositions comprising CoV S polypeptides or nanoparticles, detergent-core nanoparticles, and HaSMaNs are administered to a patient that has or has previously had a confirmed infection caused by SARS-CoV-2 or a heterogeneous SARS-CoV-2 strain. The infection with SARS-CoV-2 or a heterogeneous SARS-CoV-2 strain may be confirmed by a nucleic acid amplification test (e.g., polymerase chain reaction) or serological testing (e.g., testing for antibodies against a SARS-CoV-2 viral antigen). In embodiments, the composition comprising CoV S polypeptides or nanoparticles, detergent-core nanoparticles, HaSMaNs, or combinations thereof, are administered to a patient at least about 3 days, at least about 1 week, at least about 2 weeks, at least about 3 weeks, at least about 4 weeks after a patient has been diagnosed with COVID-19. In embodiments, the composition comprising CoV S polypeptides or nanoparticles, detergent-core nanoparticles, HaSMaNs, or combinations thereof, are administered to a patient between 1 week and 1 year after the patient's diagnosis with COVID-19, for example, about 1 week, about 2 weeks, about 3 weeks, about 4 weeks, about 5 weeks, about 6 weeks, about 1 month, about 2 months, about 3 months, about 4 months, about 5 months, about 6 months, about 7 months, about 8 months, about 9 months, about 10 months, about 11 months, or about 1 year. In embodiments, the composition comprising CoV S polypeptides or nanoparticles, detergent-core nanoparticles, HaSMaNs, or combinations thereof, are administered to a patient between 1 week and 20 years after the patient's diagnosis with COVID-19, for example, about 1 week, about 2 weeks, about 3 weeks, about 4 weeks, about 5 weeks, about 6 weeks, about 1 month, about 2 months, about 3 months, about 4 months, about 5 months, about 6 months, about 7 months, about 8 months, about 9 months, about 10 months, about 11 months, about 1 year, about 2 years, about 3 years, about 4 years, about 5 years, about 6 years, about 7 years, about 8 years, about 9 years, about 10 years, about 11 years, about 12 years, about 13 years, about 14 years, about 15 years, about 16 years, about 17 years, about 18 years, about 19 years, or about 20 years.

In embodiments, the composition comprising CoV S polypeptides or nanoparticles, detergent-core nanoparticles, HaSMaNs, or combinations thereof, are administered after the patient has been administered a first immunogenic composition. Non-limiting examples of first immunogenic compositions include a SARS-CoV-2 Spike glycoprotein, an mRNA encoding a SARS-Cov-2 Spike glycoprotein, a plasmid DNA encoding a SARS-Cov-2 Spike glycoprotein, an viral vector encoding a SARS-Cov-2 Spike glycoprotein, or an inactivated SARS-CoV-2 virus. In embodiments, the CoV S polypeptides or nanoparticles comprising the same are administered between about 1 week and about 1 year, between about 1 week and 1 month, between about 3 weeks and 4 weeks, between about 1 week and 5 years, between about 1 year and about 5 years, between about 1 year and about 3 years, between about 3 years and about 5 years, between about 5 years and about 10 years, between about 1 year and about 10 years, or between about 1 year and about 2 years after administration of the first immunogenic composition. In embodiments, the CoV S polypeptides or nanoparticles comprising the same are administered between about 1 week and about 1 year after administration of the first immunogenic composition, for example, about 1 week, about 2 weeks, about 3 weeks, about 4 weeks, about 5 weeks, about 6 weeks, about 7 weeks, about 8 weeks, about 9 weeks, about 10 weeks, about 1 month, about 2 months, about 3 months, about 4 months, about 5 months, about 6 months, about 7 months, about 8 months, about 9 months, about 10 months, about 11 months, or about 1 year after administration of the first immunogenic composition.

In embodiments, the composition comprising CoV S polypeptides or nanoparticles comprising CoV S polypeptides, detergent-core nanoparticles, HaSMaNs, or combinations thereof, are useful for preparing immunogenic compositions to stimulate an immune response that confers immunity or substantial immunity to one or more of MERS, SARS, SARS-CoV-2, and a heterogeneous SARS-CoV-2 strain. Both mucosal and cellular immunity may contribute to immunity to infection and disease. Antibodies secreted locally in the upper respiratory tract are a major factor in resistance to natural infection. Secretory immunoglobulin A (sIgA) is involved in protection of the upper respiratory tract and serum IgG in protection of the lower respiratory tract. The immune response induced by an infection protects against reinfection with the same virus or an antigenically similar viral strain. The antibodies produced in a host after immunization with the nanoparticles disclosed herein can also be administered to others, thereby providing passive administration in the subject.

In embodiments, the composition comprising CoV S polypeptides or nanoparticles, detergent-core nanoparticles, HaSMaNs, or combinations thereof, induce cross-neutralizing antibodies against SARS-CoV-2 viruses containing S proteins with one or more modifications selected from:

(a) deletion of one or more amino acids of the NTD, wherein the one or more amino acids are selected from the group consisting of amino acid 56, 57, 131, 132, 144, 145, 228, 229, 230, 231, 234, 235, 236, 237, 238, 239, 240, or combinations thereof; and (b) mutation of one or more amino acids of the NTD, wherein the one or more mutations are selected from the group consisting of amino acid 5, 6, 7, 13, 39, 51, 53, 54, 56, 57, 62, 63, 67, 82, 125, 129, 131, 132, 133, 139, 143, 144, 145, 177, 200, 201, 202, 209, 229, 233, 240, 245, or combinations thereof;

(c) mutation of one or more amino acids of the RBD wherein the one or more mutations is selected from the group consisting of amino acid 333, 404, 419, 426, 439, 440, 464, 465, 471, 477, 481, 488, and combinations thereof;

(d) mutation to one or more amino acids of the SD1/2, wherein the one or more amino acids is selected from the group consisting of 557, 600, 601, 642, 664, 668, and combinations thereof;

(e) an inactive furin cleavage site (corresponding to one or more mutations in amino acids 669-672);

(f) deletion of one or more amino acids of the S2 subunit, wherein the amino acids are selected from the group consisting of 676-685, 676-702, 702-711, 775-793, 806-815; and combinations thereof (g) mutation of one or more amino acids of the S2 subunit, wherein the amino acids are selected from the group consisting of 688, 703, 846, 875, 937, 969, 973, 974, 1014, 1058, 1105, and 1163; and combinations thereof (h) deletion of one or more amino acids from the TMCT (amino acids 1201-1260), wherein the amino acids of the CoV S glycoprotein are numbered with respect to SEQ ID NO: 2.

In embodiments, the composition comprising CoV S polypeptides or nanoparticles comprising CoV S polypeptides, detergent-core nanoparticles, HaSMaNs, or combinations thereof, induce cross-neutralizing antibodies against SARS-CoV-2 viruses containing S proteins with one or more modifications selected from: deletions of amino acid 56, deletion of amino acid 57, deletion of amino acid 131, N488Y, A557D, D601G, P668H, T703I, S969A, D1105H, N426K, and Y440F, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses containing S proteins with one or more modifications selected from: deletions of amino acid 56, deletion of amino acid 57, deletion of amino acid 131, N488Y, A557D, D601G, P668H, T703I, S969A, and D1105H, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses containing S proteins with one or more modifications selected from: D67A, D202G, L229H, K404N, E471K, N488Y, D601G, and A688V, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses containing S proteins with one or more modifications selected from: deletion of amino acids 229-231, D67A, D202G, K404N, E471K, N488Y, D601G, and A688V, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses containing S proteins with one or more modifications selected from: deletion of amino acids 229-231, L5F, D67A, D202G, K404N, E471K, N488Y, D601G, and A688V wherein the amino acids are numbered with respect to a CoV S polypeptide having an amino acid sequence of SEQ ID NO: 2.

In embodiments, the composition comprising CoV S polypeptides or nanoparticle comprising CoV S polypeptides, detergent-core nanoparticles, HaSMaNs, or combinations thereof, induces cross-neutralizing antibodies against SARS-CoV-2 viruses containing S proteins with one or more modifications selected from: L5F, T7N, P13S, D125Y, R177S, K404T, E471K, N488Y, D601G, H642Y, T1014I , and V1163F, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses with an S protein comprising one or more modifications selected from: W139C and L439R, wherein the amino acids are numbered with respect to a CoV S polypeptide having an amino acid sequence of SEQ ID NO: 2. In embodiments, the CoV S protein comprising W139C and L439R modifications is expressed with a signal peptide having an amino acid sequence of SEQ ID NO: 117 or SEQ ID NO: 5. In embodiments, the CoV S protein or nanoparticle comprising a CoV S protein induces cross-neutralizing antibodies against SARS-CoV-2 viruses with one or more modifications selected from: D601G, W139C, and L439R, wherein the amino acids are numbered with respect to a CoV S polypeptide having an amino acid sequence of SEQ ID NO: 2. In embodiments, the CoV S protein or nanoparticle comprising D601G, W139C, and L439R modifications is expressed with a signal peptide having an amino acid sequence of SEQ ID NO: 117 or SEQ ID NO: 5.

In embodiments, the composition comprising CoV S polypeptides or nanoparticles comprising CoV S polypeptides, detergent-core nanoparticles, HaSMaNs, or combinations thereof, induces cross-neutralizing antibodies against SARS-CoV-2 viruses with one or more modifications selected from: D601G, L5F, D67A, D202G, deletions of amino acids 229-231, R233I, K404N, E471K, N488Y, and A688V, wherein the amino acids are numbered with respect to a CoV S polypeptide having an amino acid sequence of SEQ ID NO: 2. In embodiments, the composition comprising CoV S polypeptides or nanoparticles, detergent-core nanoparticles, HaSMaNs, or combinations thereof, induces cross-neutralizing antibodies against SARS-CoV-2 viruses with one or more modifications selected from: L5F, D67A, D202G, deletions of amino acids 229-231, R233L, K404N, E471K, N488Y, and A688V, wherein the amino acids are numbered with respect to a CoV S polypeptide having an amino acid sequence of SEQ ID NO: 2.

In embodiments, the composition comprising CoV S polypeptides or nanoparticles comprising CoV S polypeptides, detergent-core nanoparticles, HaSMaNs, or combinations thereof described herein, have an efficacy at preventing coronavirus disease-19 (COVID-19) from a SARS-CoV-2 virus or a heterogeneous SARS-CoV-2 strain (e.g., a B.1.1.7 SARS-CoV-2 strain, B.1.351 SARS-CoV-2 strain, P.1 SARS-CoV-2 strain, B.1.617.2 SARS-CoV-2 strain, B.1.525 SARS-CoV-2 strain, B.1.526 SARS-CoV-2 strain, B.1.617.1 SARS-CoV-2 strain, a C.37 SARS-CoV-2 strain, B.1.621 SARS-CoV-2 strain, a B.1.1.529 SARS-CoV-2 strain, or a Ca1.20C SARS-CoV-2 strain) that is from about 50% to about 99%, from about 80% to about 99%, from about 75% to about 99%, from about 80% to about 95%, from about 90% to about 98%, from about 75% to about 95%, from about 80% to about 90%, from about 85% to about 95%, from about 80% to about 95% at least about 50%, at least about 55%, at least about 60%, at least about 65%, at least about 70%, at least about 75%, at least about 80%, at least about 85%, at least about 90%, at least about 91%, at least about 92%, at least about 93%, at least about 94%, at least about 95%, at least about 96%, at least about 97%, at least about 98%, or at least about 99% for up to about 1 month, up to about 2 months, up to about 2.5 months, up to about 3 months, up to about 3.5 months, up to about 4 months, up to about 4.5 months, up to about 5 months, up to about 5.5 months, up to about 6 months, up to about 6.5 months, up to about 7 months, up to about 7.5 months, up to about 8 months, up to about 8.5 months, up to about 9 months, up to about 9.5 months, up to about 10 months, up to about 10.5 months, up to about 11 months, up to about 11.5 months, up to about 12 months, up to about 12.5 months, up to about 13 months, up to about 13.5 months, up to about 14 months, up to about 14.5 months, up to about 15 months, up to about 15.5 months, up to about 16 months, up to about 16.5 months, up to about 17 months, up to about 17.5 months, up to about 18 months, up to about 18.5 months, up to about 19 months, up to about 19.5 months, up to about 20 months, up to about 20.5 months, up to about 21 months, up to about 21.5 months, up to about 22 months, up to about 22.5 months, up to about 23 months, up to about 23.5 months, up to about 24 months, up to about 2.1 years, up to about 2.2 years, up to about 2.3 years, up to about 2.4 years, up to about 2.5 years, up to about 2.6 years, up to about 2.7 years, up to about 2.8 years, up to about 2.9 years, up to about 3 years, or longer after administration of the last dose of nanoparticles or CoV S polypeptides described herein. In embodiments, the COVID-19 is mild COVID-19. In embodiments, the COVID-19 is moderate COVID-19. In embodiments, the COVID-19 is severe COVID-19. In embodiments, the COVID-19 is asymptomatic COVID-19.

In embodiments, the present disclosure provides a method of producing one or more of high affinity anti-MERS-CoV, anti-SARS-CoV, anti-SARS-CoV-2, or anti-influenza virus antibodies. The high affinity antibodies produced by immunization with the nanoparticles disclosed herein are produced by administering an immunogenic composition comprising CoV S polypeptides or nanoparticles, detergent-core nanoparticles, HaSMaNs, or combinations thereof, to an animal, collecting the serum and/or plasma from the animal, and purifying the antibody from the serum/and or plasma. In one embodiment, the animal is a human. In embodiments, the animal is a chicken, mouse, guinea pig, rat, rabbit, goat, human, horse, sheep, or cow. In one embodiment, the animal is bovine or equine. In another embodiment, the bovine or equine animal is transgenic. In yet a further embodiment, the transgenic bovine or equine animal produces human antibodies. In embodiments, the animal produces monoclonal antibodies. In embodiments, the animal produces polyclonal antibodies. In one embodiment, the method further comprises administration of an adjuvant or immune stimulating compound. In a further embodiment, the purified high affinity antibody is administered to a human subject. In one embodiment, the human subject is at risk for infection with one or more of MERS, SARS, SARS-CoV-2, and influenza virus.

In some embodiments, the disclosure provides co-formulation (i.e., prefilled syringes or pre-mix) strategies for immunogenic compositions comprising nanoparticles. Typical vaccine administration strategies currently being utilized are bedside mix formulations. That is, vaccine compositions and adjuvants are stored separately and are mixed prior to administration. Pre-mix, co-formulation, or prefilled syringe strategies for vaccine are less common due to the concerns of the stability of the antigens (e.g., hemagglutinin and CoV S polypeptide) and their subsequent immunogenic capabilities. The present disclosure provides immunogenic compositions that can be pre-mixed and stored in advance. The disclosed vaccination strategies and formulations may improve the efficiency of vaccination and may reduce the risks of bedside mixing errors, while maintaining the overall safety and immunogenicity.

A variety of containers may be used to store and transport the pre-mix formulations, including syringes for single administrations and plastic ampules. In some instances, plastic ampules can be manufactured using the blow-fill-seal manufacturing technique or method. In general, the blow-fill-seal (BFS) manufacturing method includes extruding a plastic material (e.g., resin) to form a parison, which is then placed into a mold and cut to size. A filling needle or mandrel is then used to inflate the plastic, which in turn, results in a hollow ampule that substantially conforms to the shape of the mold. Once inflated, a desired volume of liquid can be injected into the ampule, the filling needle or mandrel can be removed, and the ampule can be sealed. Accordingly, BFS can be an automated process that can be performed in a sterile environment without direct human intervention.

In some instances, the ability to aseptically manufacture sterile ampules containing a desired liquid can make BFS manufactured ampules particularly well suited for the pharmaceutical industry. BFS technology, however, has not been compatible with all pharmaceutical liquids, products, etc. For example, some known BFS manufacturing methods include delivering the liquid or product into the ampule while the plastic is still relatively hot, which can result in adverse effects to temperature sensitive liquids and/or products such as vaccines, biologics, etc. Advances in cool BFS technology, however, have increased the variety of suitable products, liquids, etc. allowing some vaccines, biologics, and/or other temperature sensitive pharmaceuticals to be contained in BFS ampules.

In some instances, a BFS ampule can have a size, shape, and/or configuration that is at least partially based on a desired use and/or a desired pharmaceutical liquid or dosage that the ampule is configured to contain. For example, some known BFS ampules can include a pierce through top, a twist-off top, a top including a male or female luer, and/or the like. Some known BFS ampules can have a size and/or shape based on volume of the liquid or dosage configured to be disposed therein. In addition, some known BFS ampules can be manufactured in a strip of multiple, temporarily connected ampules, which can increase manufacturing, packaging, and/or storing efficiencies and/or the like.

In embodiments, the immunogenic compositions described herein are provided in pre-filled syringes. When the immunogenic composition is prepared in a pre-filled syringe, an antigen and adjuvant is combined in advance of administration. In embodiments, the pre-filled syringe contains hemagglutinin and CoV S polypeptide. In embodiments, the pre-filled syringe contains hemagglutinin and does not contain CoV S polypeptide. In embodiments, the pre-filled syringe contains CoV S polypeptide and does not contain hemagglutinin.

In embodiments, a subject is administered an immunogenic composition from a pre-filled syringe. In embodiments, the subject is administered an immunogenic composition containing both hemagglutinin and CoV S polypeptide in a single pre-filled syringe. In embodiments, the subject is administered an immunogenic composition from a pre-filled syringe that contains a CoV S polypeptide, but does not contain hemagglutinin. In embodiments, the subject is administered an immunogenic composition from a pre-filled syringe that contains hemagglutinin, but does not contain a CoV S polypeptide.

All patents, patent applications, references, and journal articles cited in this disclosure are expressly incorporated herein by reference in their entireties for all purposes.

EXAMPLES

Example 1

Expression and Purification of Coronavirus Spike (5) Polypeptide Nanoparticles

Figure 4:
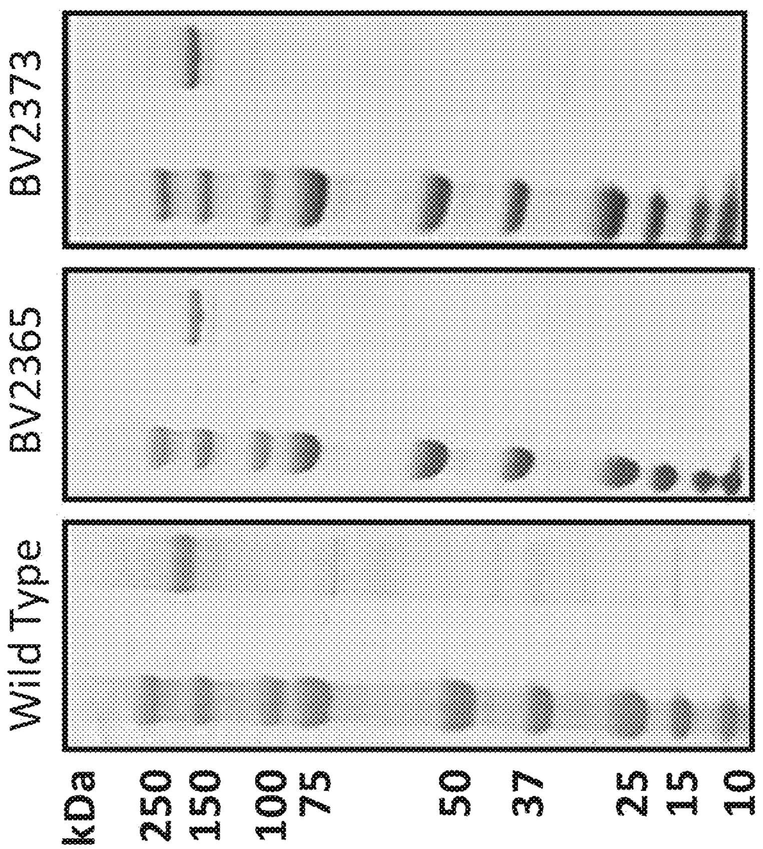
FIG. 4 shows purification of the wild type CoV S polypeptide and the CoV S polypeptides BV2365 and BV2373.

The native coronavirus Spike (S) polypeptide (SEQ ID NO: 1 and SEQ ID NO:2) and CoV Spike polypeptides which have amino acid sequences corresponding to SEQ ID NOS: 3, 4, 38, 41, 44, 48, 51, 54, 58, 61, 63, 65, 67, 73, 75, 78, 79, 82, 83, 85, 87, 106, 108, 89, 112-115, 132, 133, 114, 138, 141, 144, 147, 151, 153, 156, and 158 have been expressed in a baculovirus expression system and recombinant plaques expressing the coronavirus Spike ( ) polypeptides were picked and confirmed. In each case the signal peptide is SEQ ID NO: 5. FIG. 2 and FIG. 4 show successful purification of the CoV Spike polypeptides BV2364, BV2365, BV2366, BV2367, BV2368, BV2369, BV2373, BV2374, and BV2375. Table 2 shows the sequence characteristics of the aforementioned CoV Spike polypeptides.

TABLE 2

Selected CoV Spike Polypeptides

| CoV S polypeptide | Modification | SEQ ID NO. |
|---|---|---|
| BV2364 | Deleted N-Terminal Domain | 48 |
| BV2365 | Inactive furin cleavage site | 4 |
| BV2361/BV2366 | Wild-type | 2 |
| BV2367 | Deletion of amino acids 676-685, inactive furin cleavage site | 63 |
| BV2368 | Deletion of amino acids 702-711, inactive furin cleavage site | 65 |
| BV2369 | Deletion of amino acids 806-815, inactive furin cleavage site | 67 |
| BV2373, formulated into a composition referred to herein as "NVX-CoV2373" | Inactive furin cleavage site, K973P mutation, V974P mutation | 87 |
| BV2374 | K973P mutation, V974P mutation | 85 |
| BV2374 | Inactive furin cleavage site and His-tag | 58 |
| BV2384 | Inactive furin cleavage site (GSAS), K973P, V974P mutation | 110 |
| BV2425 | Inactive furin cleavage site, K973P, V974P mutation, deletions of amino acid 56, deletion of amino acid 57, deletion of amino acid 131, N488Y mutation, A557D mutation, D601G mutation, P668H mutation, T703I mutation, S969A mutation, and D1105H mutation | 114 |
| BV2426 | Inactive furin cleavage site, K973P mutation, V974P mutation, D67A mutation, D202G mutation, L229H mutation, K404N mutation, E471K mutation, N488Y mutation, D601G mutation, and A688V mutation | 115 |
| BV2438 | Inactive furin cleavage site (QQAQ: SEQ ID NO: 7), K973P mutation, V974P mutation, K404N mutation, E471K mutation, N488Y mutation, D67A mutation, D202G mutation, L229H mutation, D601G mutation, A688V mutation | 132 |
| BV2423 | Inactive furin cleavage site (GG), K973P mutation, V974P mutation, D601G mutation | 133 |
| BV2425 | Inactive furin cleavage site (QQAQ: SEQ ID NO: 7), K973P mutation, V974P mutation, deletion of amino acids 56, 57, and 131, N488Y mutation, A557D mutation, D601G mutation, P668H mutation, T703I mutation, S969A mutation, D1105H mutation | 114 |
| BV2425-2 | Inactive furin cleavage site (GG), K973P mutation, V974P mutation, deletion of amino acids 56, 57, and 131, N488Y mutation, A557D mutation, D601G mutation, P668H mutation, T703I mutation, S969A mutation, D1105H mutation | 138 |
| BV2439 | Inactive furin cleavage site (GG), K973P mutation, V974P mutation, K404N mutation, E471K mutation, N488K mutation, D67A mutation, D202G mutation, L229H mutation, D601G mutation, A688V mutation | 141 |
| BV2441 | Inactive form cleavage site (QQAQ: SEQ ID NO: 7), K973P mutation, V974P mutation, K404N mutation, E471K mutation, N488Y mutation, D67A mutation, D202G mutation, D601G mutation, A688V mutation, deletions of amino acids 229-231 | 144 |
| BV2442 | Inactive furin cleavage site (GG), K973P mutation, V974P mutation, K404N mutation, E471K mutation, N488Y mutation, D67A mutation, D202G mutation, D601G mutation, A688V mutation, deletions of amino acids 229-231 | 147 |
| BV2443 | Inactive form cleavage site (QQAQ: SEQ ID NO: 7), K973P mutation, V974P mutation, T7N mutation, P13S mutation, D125Y mutation, R177S mutation, K404T mutation, E471K mutation, N488Y mutation, D601G mutation, H642Y mutation, T1014Y mutation, V1163F mutation | 151 |
| BV2448 | Inactive furin cleavage site (QQAQ: SEQ ID NO: 7), K973P mutation, V974P mutation, W139C mutation, S481P mutation, D601G mutation, L439R mutation | 153 |
| BV1.526NY-1 | Inactive furin cleavage site (QQAQ: SEQ ID NO: 7), K973P mutation, V974P mutation, T82I mutation, D240G mutation, E471K mutation, D601G mutation, A688V mutation | 156 |
| BV1.526NY-2 | Inactive form cleavage site (QQAQ: SEQ ID NO: 7), K973P mutation, V974P mutation, T82I mutation, D240G mutation, E464K mutation, D601G mutation, A688V mutation | 158 |
| BV2465 | Mutations: T6R, G129D, R145G, L439R, T465K, D601G, P668R, D937G, K973P, V974P, Inactive Furin Cleavage site (QQAQ: SEQ ID NO: 7) Deletion: 143, 144 | 164 |
| BV2457 | T82I, G129D, E141K, L439R, T471Q, D601G, P668R, Q1058H, K973P, V974P, Inactive Furin Cleavage site (QQAQ: SEQ ID NO: 7) | 165 |
| BV2472 | Mutations: T6R, G129D, R145G, K404N, L439R, T465K, D601G, P668R, D937G, W245I, K973P, V974P, Inactive Furin Cleavage site (QQAQ: SEQ ID NO: 7) Deletion: 143, 144 | 166 |

TABLE 2-continued

| Selected CoV Spike Polypeptides | | |
|---|---|---|
| CoV S polypeptide | Modification | SEQ ID NO. |
| BV2480 | T82I, Y131S, Y132N, R333K, E471K, N488Y, D601G, P668H, D937N, Inactive Furin Cleavage site (QQAQ: SEQ ID NO: 7), K973P mutation, V974P mutation | 167 |
| BV2481 | T82I, Y131T, Y132S, R333K, E471K, N488Y, D601G, P668H, D937N, Inactive Furin Cleavage site (QQAQ: SEQ ID NO: 7), K973P mutation, V974P mutation Insertion of asparagine after amino acid 132 | 168 |

The wild-type BV2361 protein (SEQ ID NO: 2) binds to human angiotensin-converting enzyme 2 precursor (hACE2). Bio-layer interferometry and ELISA were performed to assess binding of the CoV S polypeptides.

Protein and Nanoparticle Production

The recombinant virus is amplified by infection of Sf9 insect cells. A culture of insect cells is infected at ~3 MOI (Multiplicity of infection=virus ffu or pfu/cell) with baculovirus. The culture and supernatant is harvested 48-72 hrs post-infection. The crude cell harvest, approximately 30 mL, is clarified by centrifugation for 15 minutes at approximately 800×g. The resulting crude cell harvests containing the coronavirus Spike (S) protein are purified as nanoparticles as described below.

To produce nanoparticles, non-ionic surfactant TERGITOL® nonylphenol ethoxylate NP-9 is used in the membrane protein extraction protocol. Crude extraction is further purified by passing through anion exchange chromatography, lentil lectin affinity/HIC and cation exchange chromatography. The washed cells are lysed by detergent treatment and then subjected to low pH treatment which leads to precipitation of BV and Sf9 host cell DNA and protein. The neutralized low pH treatment lysate is clarified and further purified on anion exchange and affinity chromatography before a second low pH treatment is performed.

Affinity chromatography is used to remove Sf9/BV proteins, DNA and NP-9, as well as to concentrate the coronavirus Spike (S) protein. Briefly, lentil lectin is a metalloprotein containing calcium and manganese, which reversibly binds polysaccharides and glycosylated proteins containing glucose or mannose. The coronavirus Spike (S) protein-containing anion exchange flow through fraction is loaded onto the lentil lectin affinity chromatography resin (Capto Lentil Lectin, GE Healthcare). The glycosylated coronavirus Spike (S) protein is selectively bound to the resin while non-glycosylated proteins and DNA are removed in the column flow through. Weakly bound glycoproteins are removed by buffers containing high salt and low molar concentration of methyl alpha-D-mannopyranoside (MMP).

The column washes are also used to detergent exchange the NP-9 detergent with the surfactant polysorbate 80 (PS80). The coronavirus Spike (S) polypeptides are eluted in nanoparticle structure from the lentil lectin column with a high concentration of MMP. After elution, the coronavirus Spike (S) protein trimers are assembled into nanoparticles composed of coronavirus Spike (S) protein trimers and PS80 contained in a detergent core. The processes described in this Example are used to express and purify any CoV S polypeptide nanoparticle described herein.

Example 2

Expression and Purification of Influenza Detergent-Core Nanoparticles

HA proteins from a single strain were expressed in Sf9 cells via baculovirus infection and allowed to grow for 48-96 hours before harvesting. The HA proteins were then harvested by detergent extraction and turned into detergent core nanoparticles during purification. Briefly, the TMAE column was pre-equilibrated with buffer composed of 25 mM Tris, pH 8.0, 1.5M sodium chloride, 0.02% NP9. Sample was loaded at ≤90 cm/hr (24 min residence time) and then washed with EQ buffer (25 mM Tris, pH 8.0, 50 mM sodium chloride or 81 mM sodium chloride (A, B strains respectively), 0.02% NP-9). The purified sample was then eluted using 1.5 CV EQ buffer.

For A strains, Nanofiltration was performed for the product from the TMAE column followed by application onto a Lentil lectin affinity chromatography column pre-equilibrated with buffer composed of 25 mM Tris, 50 mM and 107 mM Sodium Chloride (for A and B strains respectively), 0.02% (w/v) NP-9, pH 8.0 for 3CV (Flow Rate: 150 cm/h). Sample was loaded at 4 min resident time. After loading, washing was performed with 3CV of the Lentil Lectin equilibration buffer. The product was eluted with 25 mM Sodium Phosphate, pH 7.5, 200 mM Sodium Chloride, 500 mM Methyl-α-D-Mannopyranoside, 0.01% (w/v) PS80, pH 7.5 by collecting 2CV's at 75 cm/hr and 8 minute residence time.

For B strains, TMAE column product was further purified using Capto Blue column. The column was equilibrated with 25 mM Tris, pH 8.0, 107 mM Sodium Chloride, 0.02% (w/v) NP-9 followed by loading the TMAE product with a flow rate of 225 cm/hr at 4 minute residence time and collection with 2CV of equilibration buffer. Nanofiltration was performed for the product from the Capto Blue column followed by application onto a Lentil lectin affinity chromatography column pre-equilibrated with buffer composed of 25 mM Tris, 50 mM and 107 mM Sodium Chloride (for A and B strains respectively), 0.02% (w/v) NP-9, pH 8.0 for 3CV (Flow Rate: 150 cm/h). Sample was loaded at 4 min resident time. After loading, washing was performed with 3CV of the Lentil Lectin equilibration buffer. The product was eluted with 25 mM Sodium Phosphate, pH 7.5, 200 mM Sodium Chloride, 500 mM Methyl-α-D-Mannopyranoside, 0.01% (w/v) PS80, pH 7.5 by collecting 2CV's at 75 cm/hr and 8 minute residence time.

The Lentil Lectin products for both A and B strains were concentrated to target HA concentration and then buffer exchanged to the final Drug Substance formulation buffer. Concentration and buffer exchange was performed by ultrafiltration and diafiltration.

Example 3

Formulation of HaSMaNs

Detergent-core nanoparticles of Example 2 are mixed with saponin adjuvant (i.e., 85% by weight Fraction A ISCOM matrix and 15% by weight Fraction C ISCOM matrix) and incubated for at least 24 hours. FIG. 7 (right panel) shows an electron microscopy image of the HaSMaNs.

Example 4

Immunogenicity and Efficacy of a Combination Vaccine Against COVID-19 and Influenza The immunogenicity and efficacy of a combination vaccine against COVID-19 and influenza, also referred to as "qNIV/CoV2373" was evaluated. The combination vaccine comprised (i) a first vaccine (referred to as "CoV2373") comprising nanoparticles containing a CoV S polypeptide (SEQ ID NO: 87) and (ii) a second vaccine (referred to as "qNIV") comprising nanoparticles containing hemagglutinin (HA) from four different influenza strains. The nanoparticles containing Type A influenza particles form HaSMaNs. The nanoparticles containing Type A influenza particles form detergent-core nanoparticles. The four different influenza strains are: A/Kansas/14/17, A/Brisbane/02/016, B/Maryland/15/16, and B/Phuket/3073/13. The "standard" combination vaccine contained 5 μg of CoV S polypeptide and 15 μg of HA per strain. The "high dose" combination vaccine contained 5 μg of CoV S polypeptide and 60 μg of HA per strain. The nanoparticles were premixed with saponin adjuvant (i.e., 85% Fraction A ISCOM matrix and 15% Fraction C ISCOM matrix).

Figure 8A:
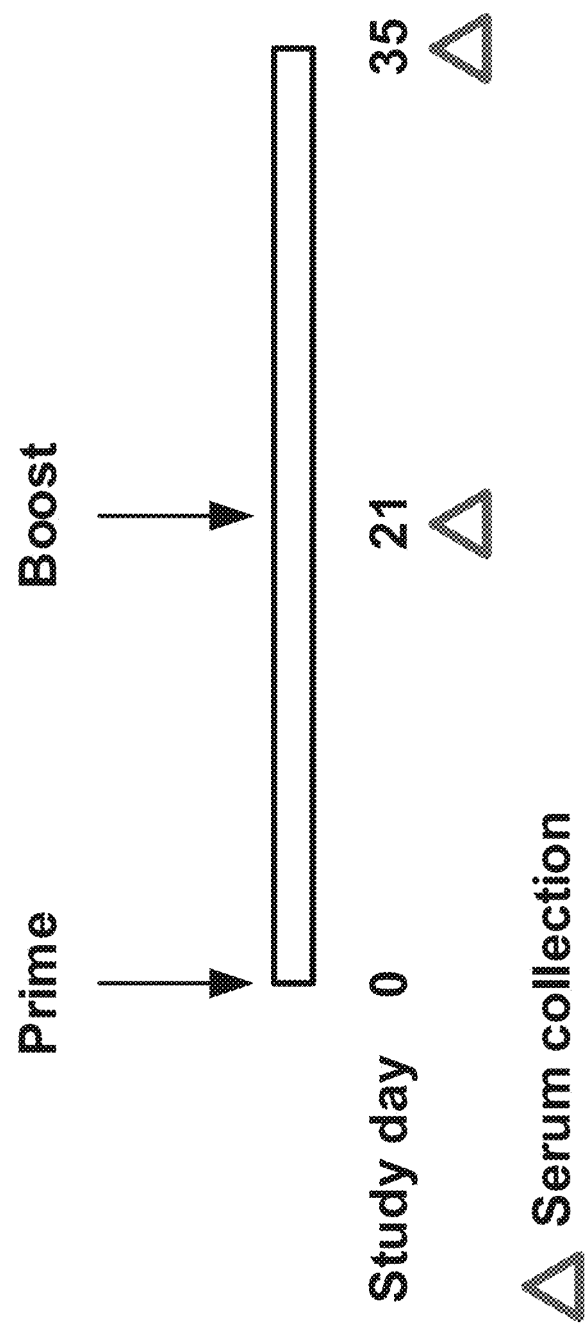
FIGS. 8A-8F show the immune response to SARS-CoV-2 spike glycoprotein and influenza hemagglutinin in ferrets immunized with qNIV/CoV2373 combination vaccine.

Groups of male and female animals were immunized with the standard vaccine or high dose vaccine. Comparator groups were immunized with vaccines containing either (i) qNIV without CoV2373 (each hemagglutinin is present at 15 μg HA/strain); (ii) qNIV without CoV2373 (each hemagglutinin is present at 50 μg HA/strain); or (iii) CoV2373 without qNIV (5 μg CoV S polypeptide). All vaccines contained 50 μg saponin adjuvant (FIG. 8A).

Figure 8B:
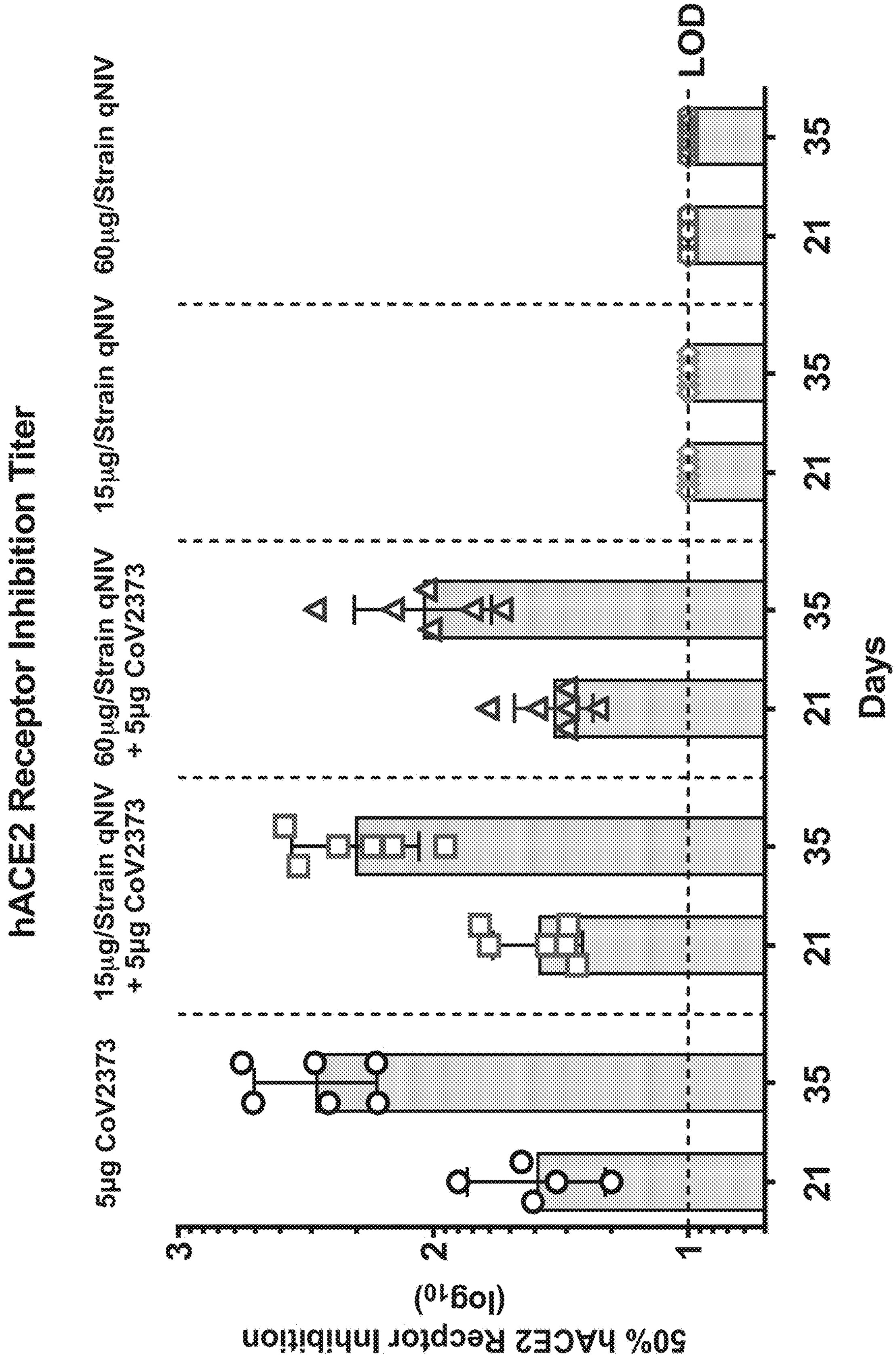
Figure 8C:
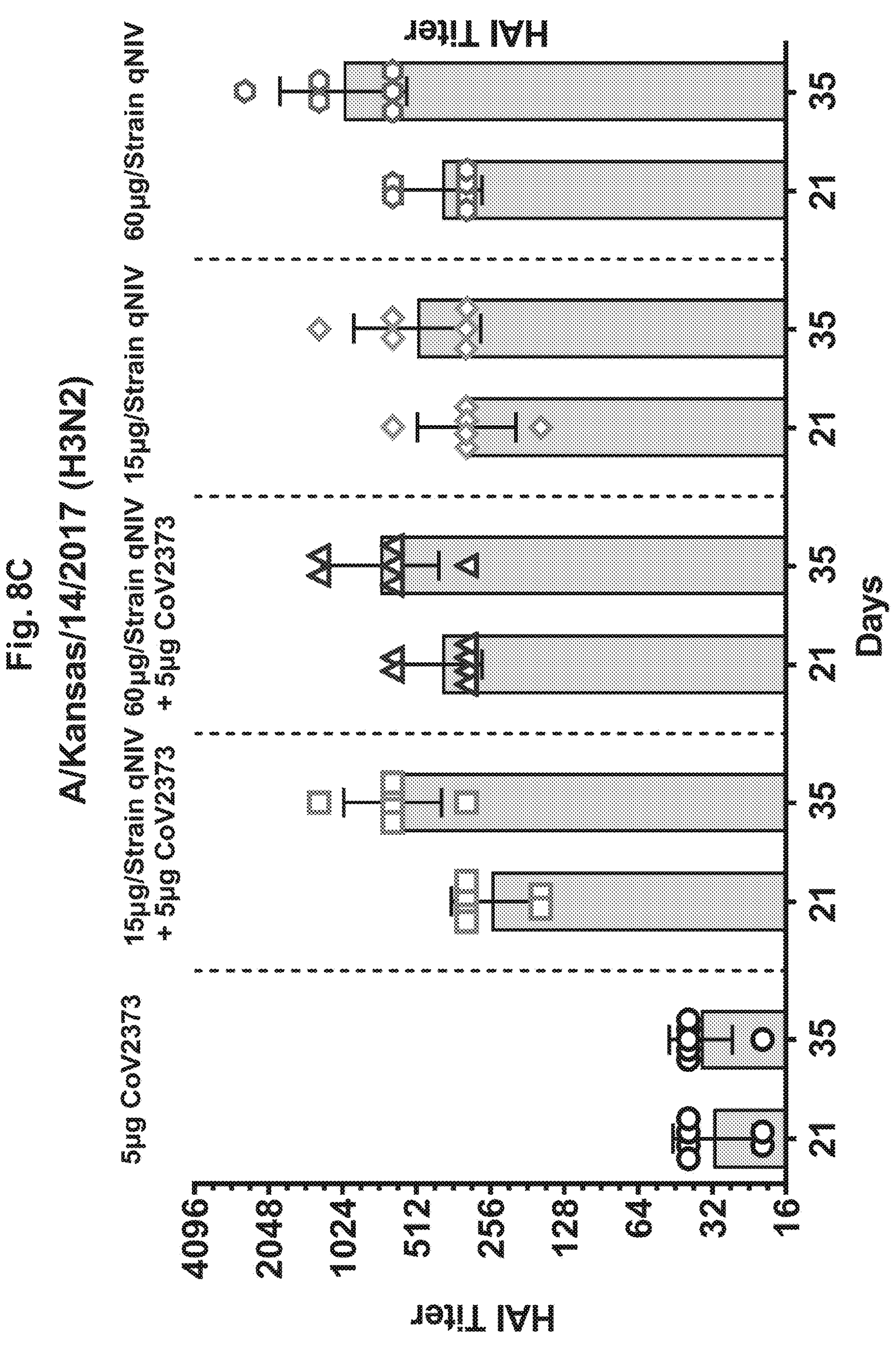
Figure 8D:
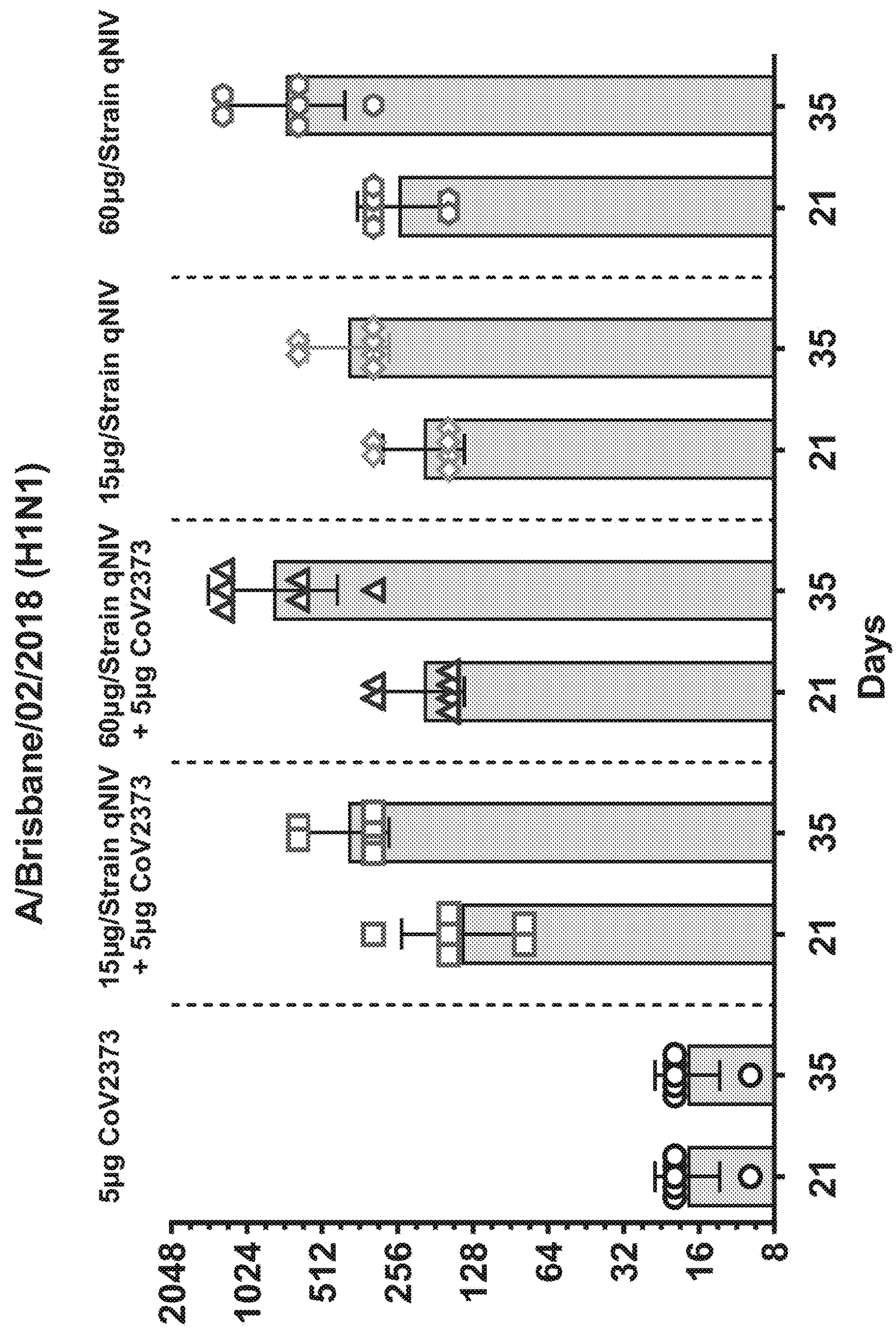
Figure 8E:
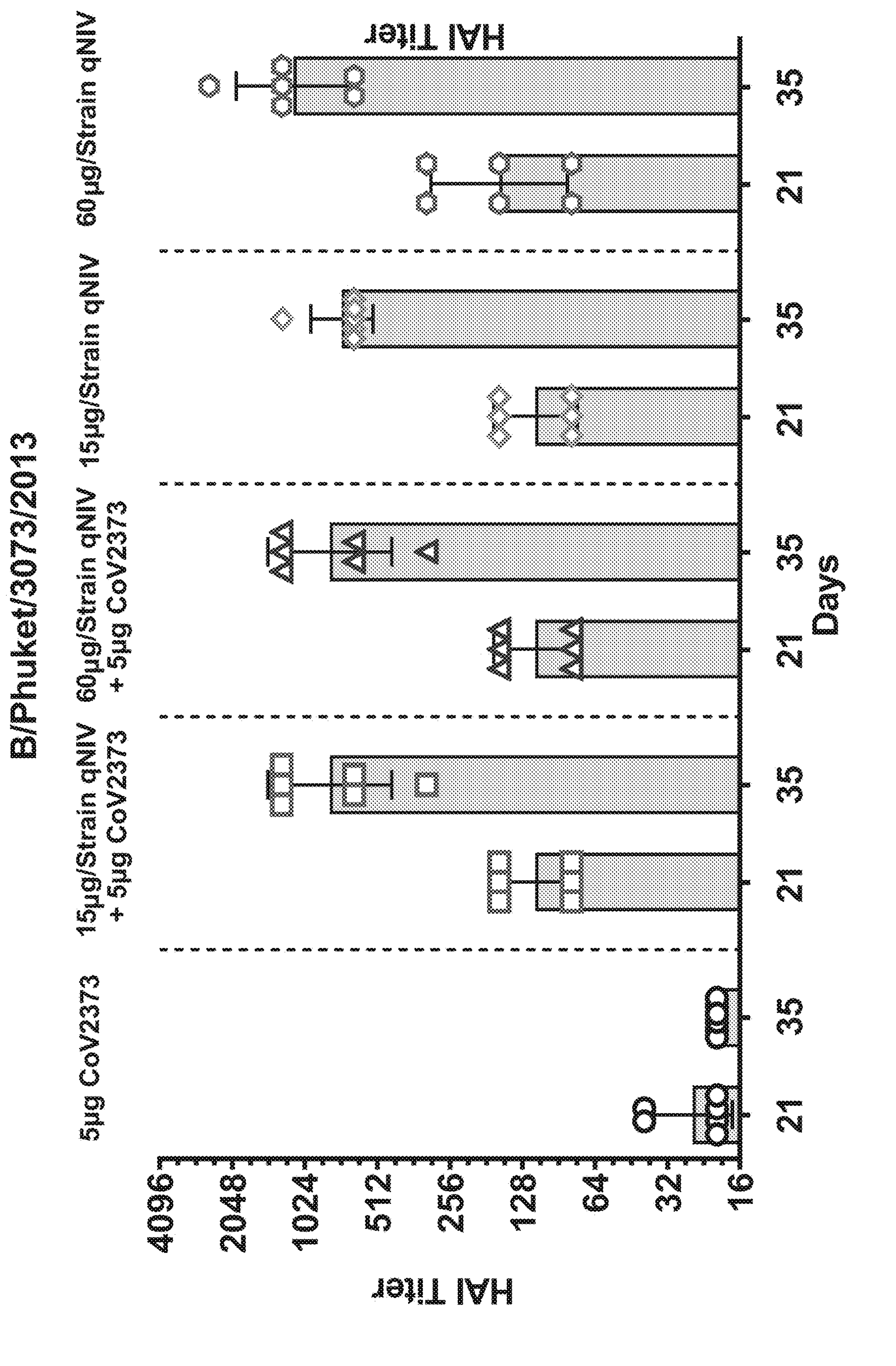
Figure 8F:
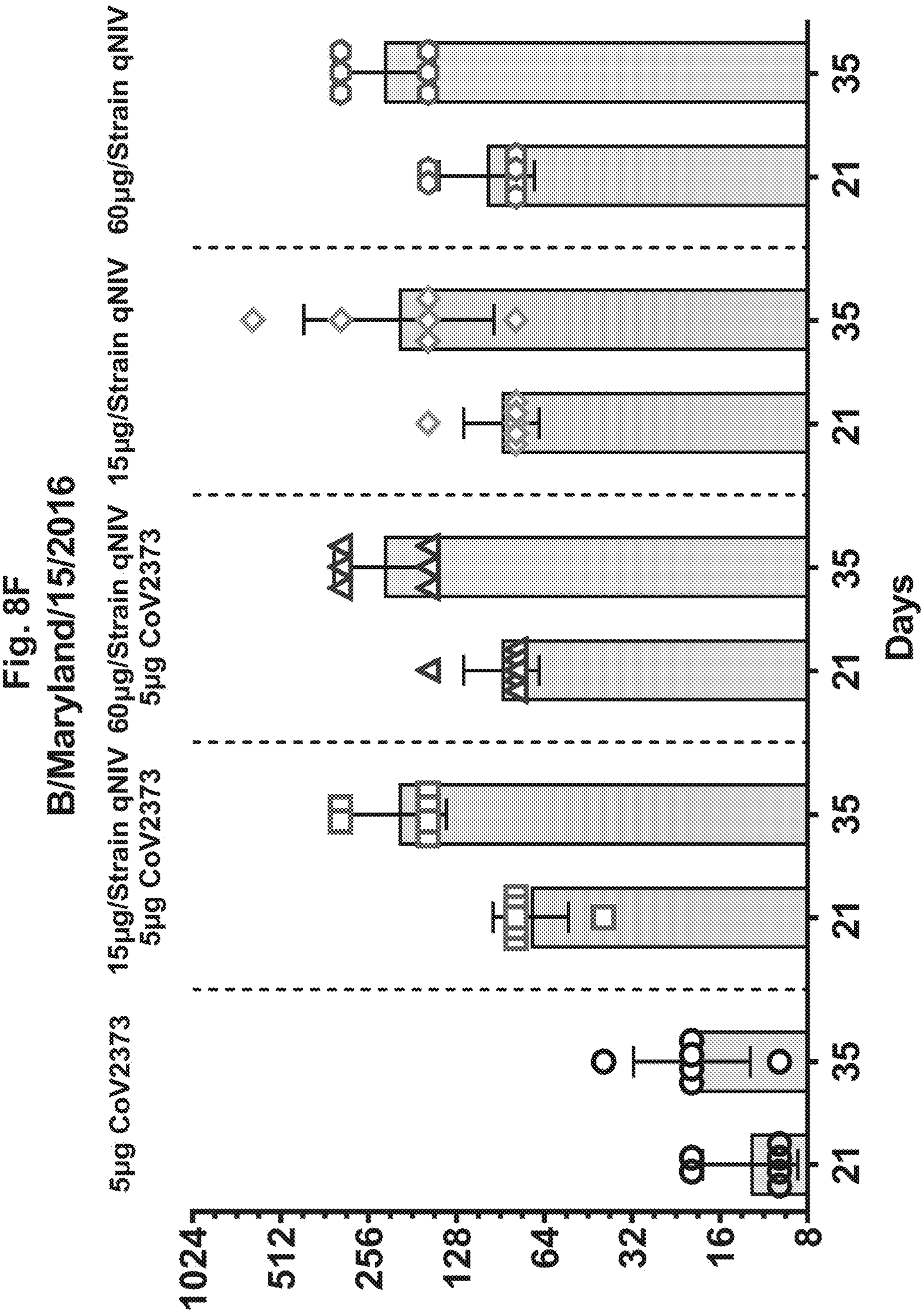

Human ACE2 receptor inhibiting antibodies levels produced by the combination vaccines were compared to animals immunized with only qNIV or only CoV2373. Animals immunized with qNIV/CoV2373 had slightly elevated levels of hACE2 receptor blocking antibodies 2 weeks after a single doses (GMT=34-39), which increased 3.2-7.3-fold (GMT 107-202) 2 weeks following the booster immunization. Human ACE2 inhibiting titers were comparable to animals immunized with nanoparticles containing 5 μg CoV2373 (GMT=290). Animals immunized with qNIV alone had no measurable hACE inhibiting antibodies (FIG. 8B). Hemagglutination inhibiting (HAI) antibody titers were compared between groups. HAI titers to influenza A and B strains were elevated 2 weeks after a single dose and boosted 2-7-fold at 2 weeks following the booster immunization. HAI titers produced by the qNIV/CoV2373 combination were comparable to HAI titers produced by immunization with low or high dose qNIV for all influenza A and B strains. Animals immunized with 5 μg CoV2373 vaccine had no measurable HAI antibodies to A or B strains (FIGS. 8C-F).

Immunogenicity qNIV/CoV2373 Combination Vaccine in Hamsters

Figure 9A:
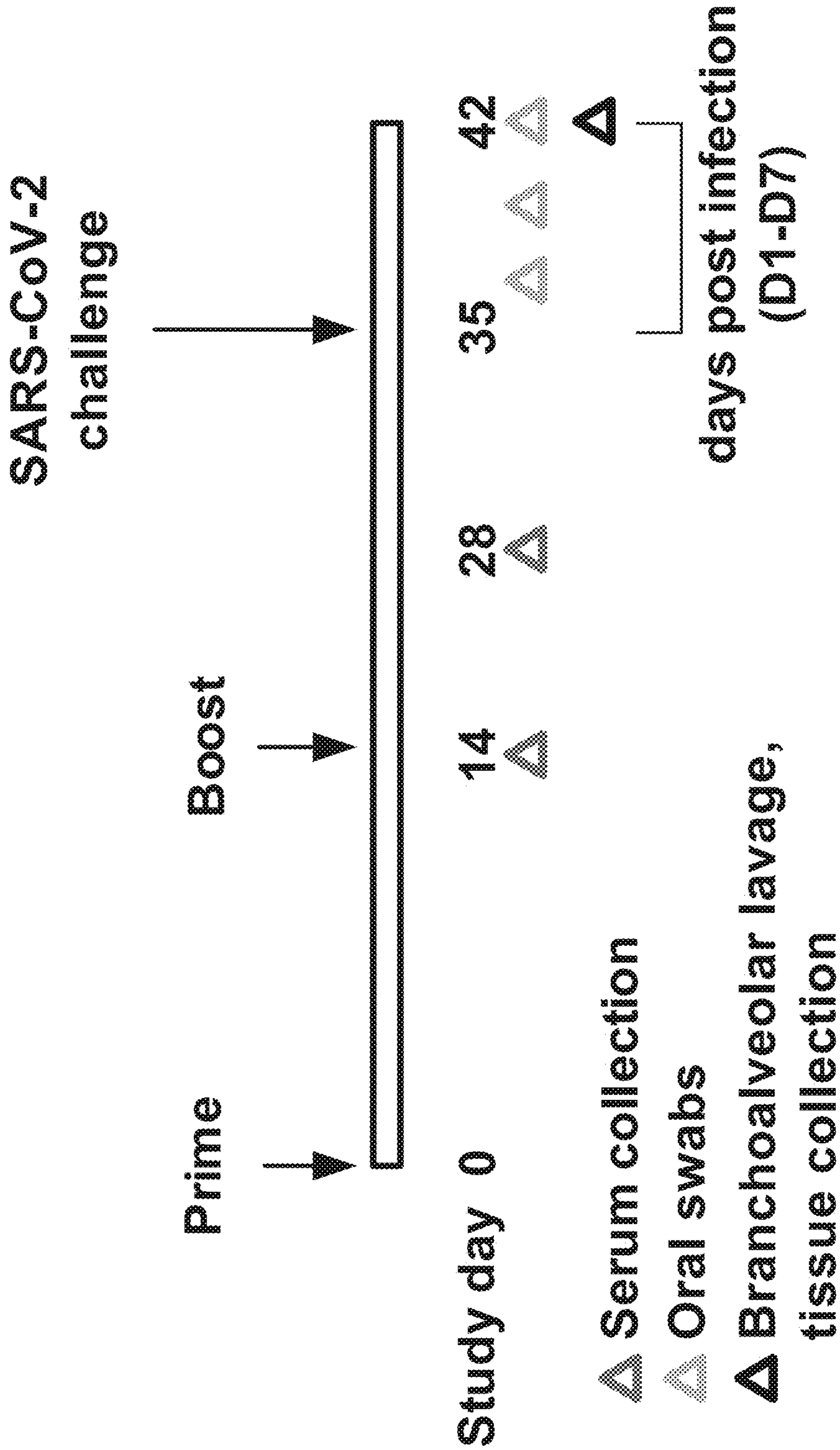
FIGS. 9A-9E show the immune response to SARS-CoV-2 spike glycoprotein and receptor blocking antibodies in hamsters immunized with qNIV/CoV2373 combination vaccine.
Figure 9B:
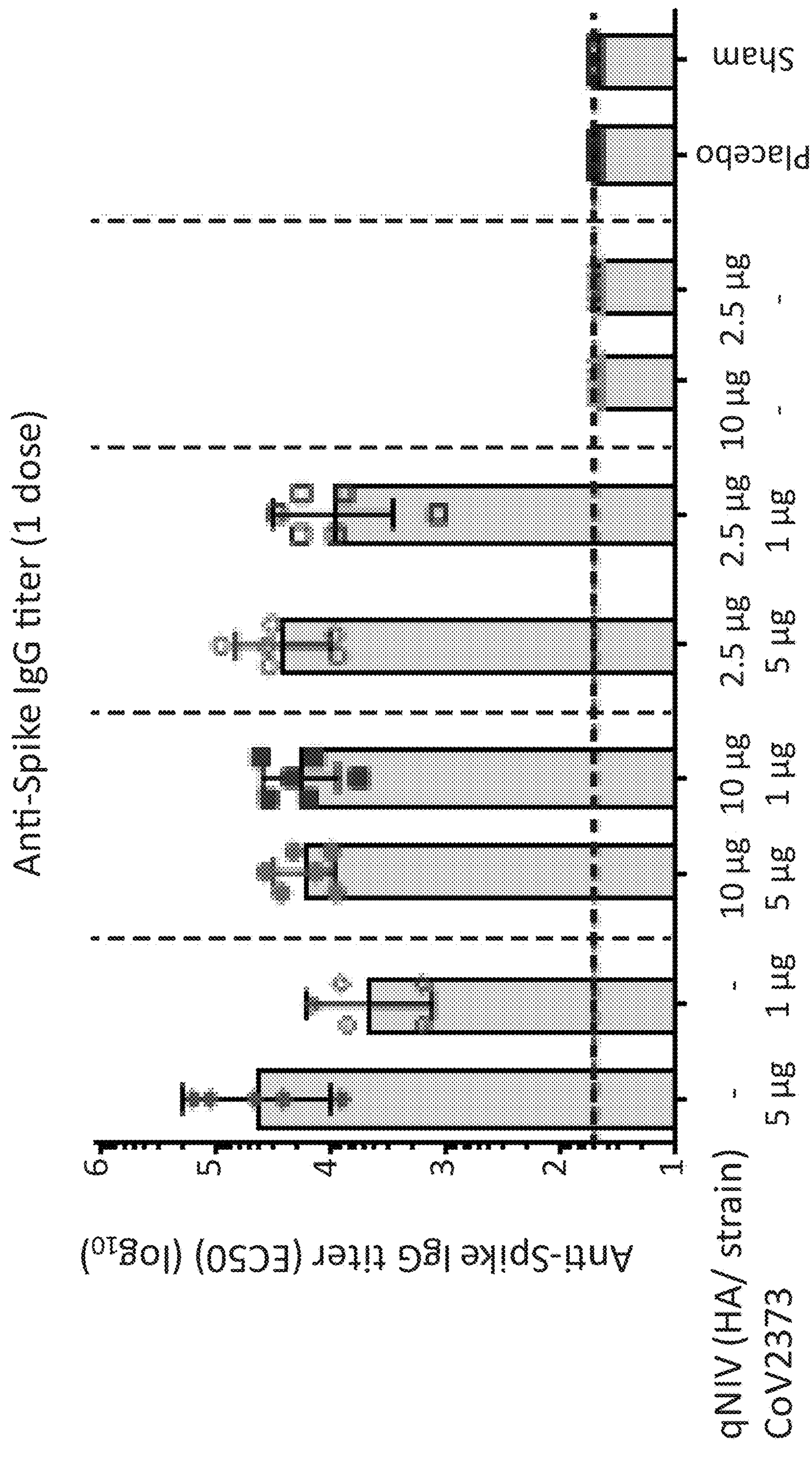
Figure 9C:
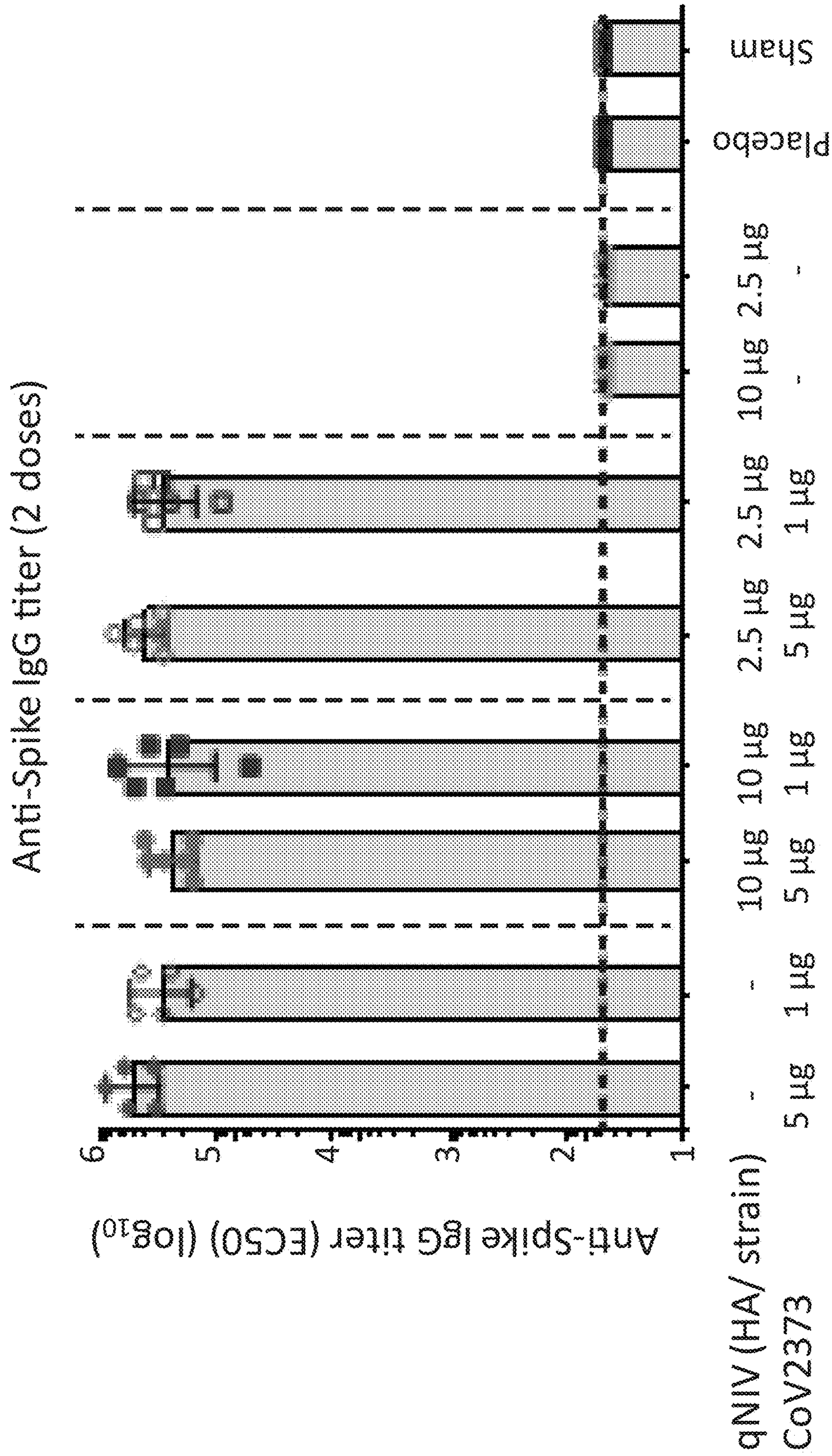

We next evaluated the immunogenicity and protection produced by qNIV/CoV2373 combination vaccine compared to vaccines containing qNIV alone or vaccines containing CoV2373 alone in hamsters challenged with SARS-CoV-2. Groups of hamsters were immunized with qNIV/CoV2373 consisting of 10 μg or 2.5 μg of HA/strain combined with 5 μg or 1 μg CoV2373. Comparator groups were immunized with the qNIV (10 μg or 2.5 μg HA/strain) or with CoV2373 (5 μg or 1 μg). All vaccine formulations were adjuvanted with 15 μg saponin adjuvant. The placebo group received formulation buffer (FIG. 9A). Animals receiving the qNIV/CoV2373 combination had elevated anti-S IgG (GMT=9467–25,295) 2 weeks after the first immunization which increased 15-30-fold (GMT=275,341–418,124) 2 weeks following the booster immunization (FIG. 9B, FIG. 9C). Anti-S IgG titers at 2 weeks after the first GMT=4576-43,632) and second doses (GMT=302,967–523,143) of monovalent CoV2373 were comparable to those in animals receiving the combined vaccines (FIG. 9B, FIG. 9C).

Figure 9D:
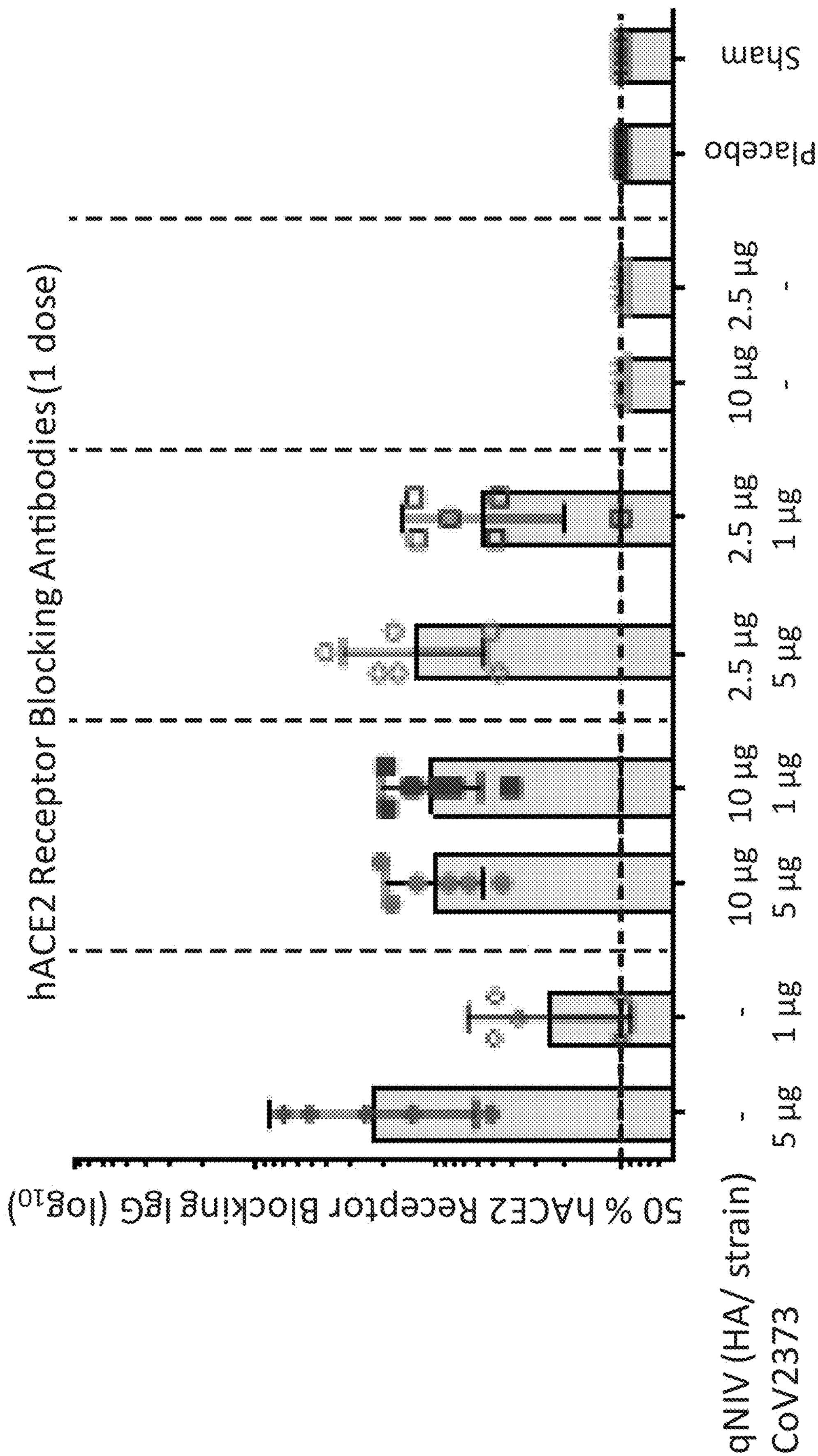
Figure 9E:
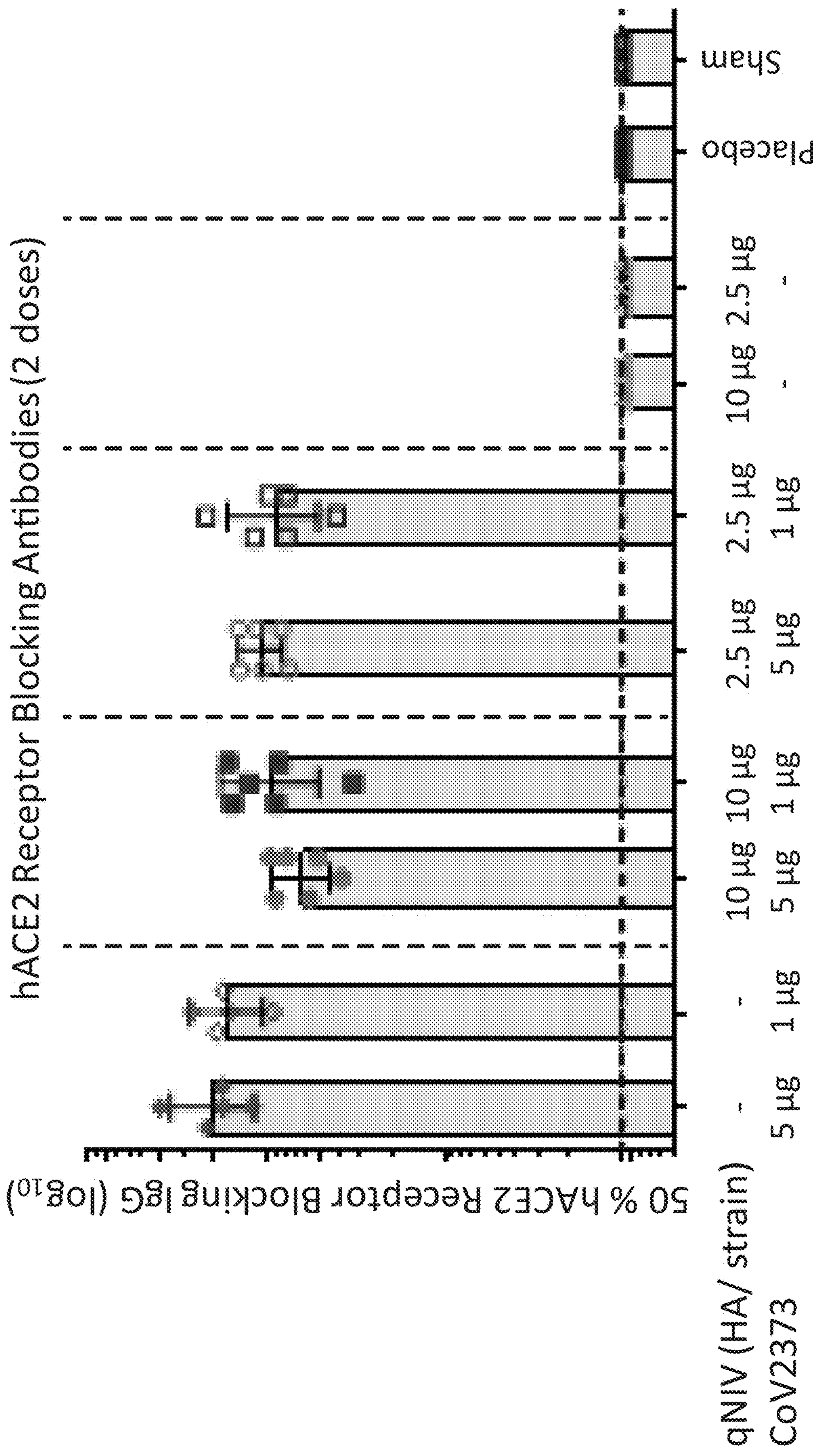

Human ACE2 receptor inhibiting antibody levels elicited by qNIV/CoV2373 combination compared to antibody levels elicited by monovalent CoV2373. Hamsters immunized with qNIV/CoV2373 had elevated antibody levels ($IC_{50}$) that block spike binding to the hACE2 receptor after a single dose (GMT=57–136). Receptor inhibiting titers increased 6.2-16.3-fold (GMT=654–1086) following the booster immunization. Human ACE2 inhibiting levels were similar to hamsters following a single immunization with CoV2373 (GMT=24–230). Human ACE2 receptor inhibiting titers increased 7.7-68-fold (GMT=1636–1769) following the booster immunization (FIG. 9D, FIG. 9E).

Figure 10A:
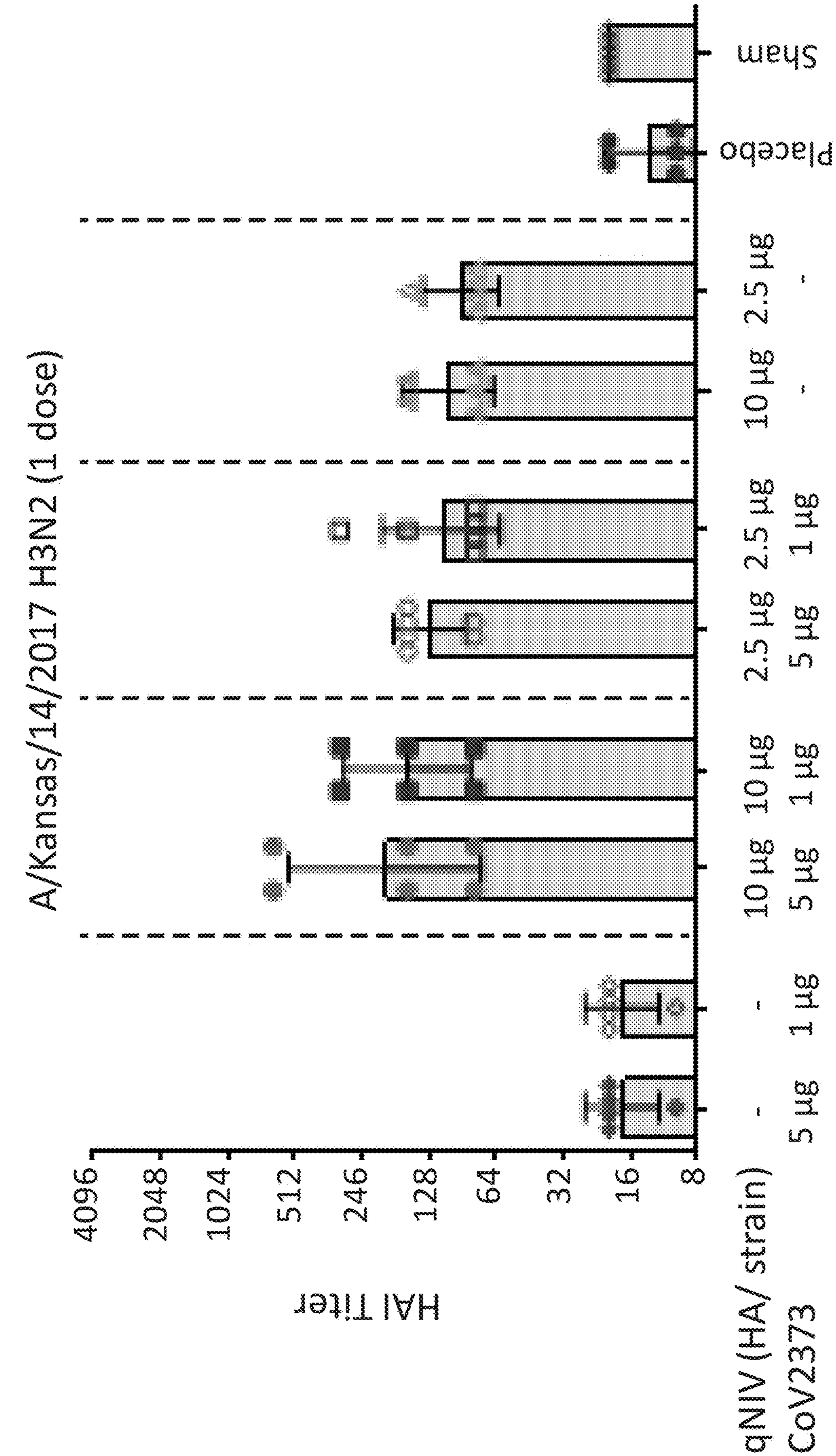
FIGS. 10A-10H show the immune response to influenza HA in hamsters immunized with qNIV/CoV2373 combination vaccine. Groups of hamsters were immunized with the combination of qNIV/CoV2373 vaccine or with the component vaccines as indicated in FIG. 8A. Serum was analyzed for hemagglutinin inhibiting antibodies (HAI) titers 14 days after one dose and 14 days after the booster immunization (study day 28).
Figure 10B:
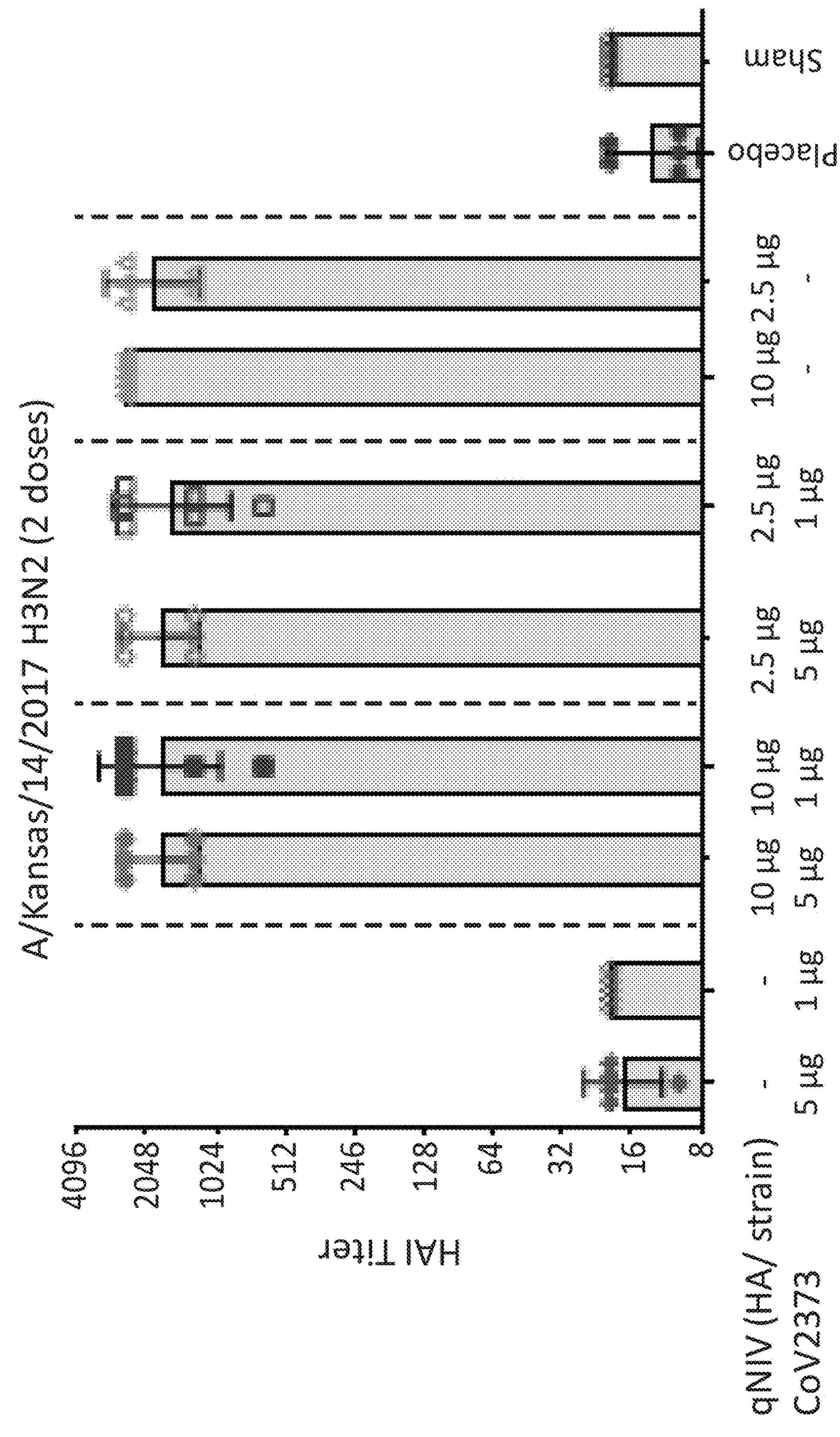
Figure 10C:
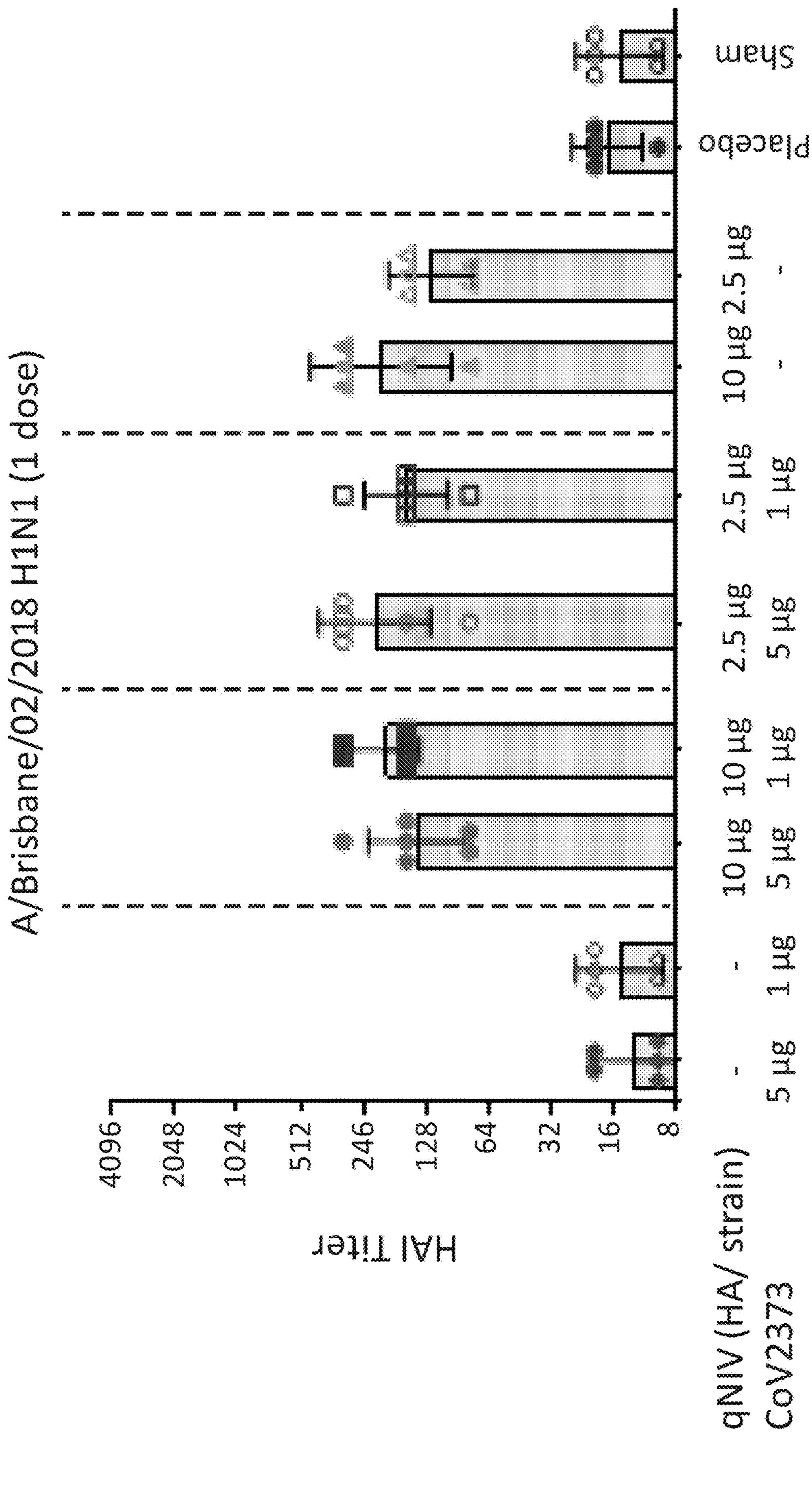
Figure 10D:
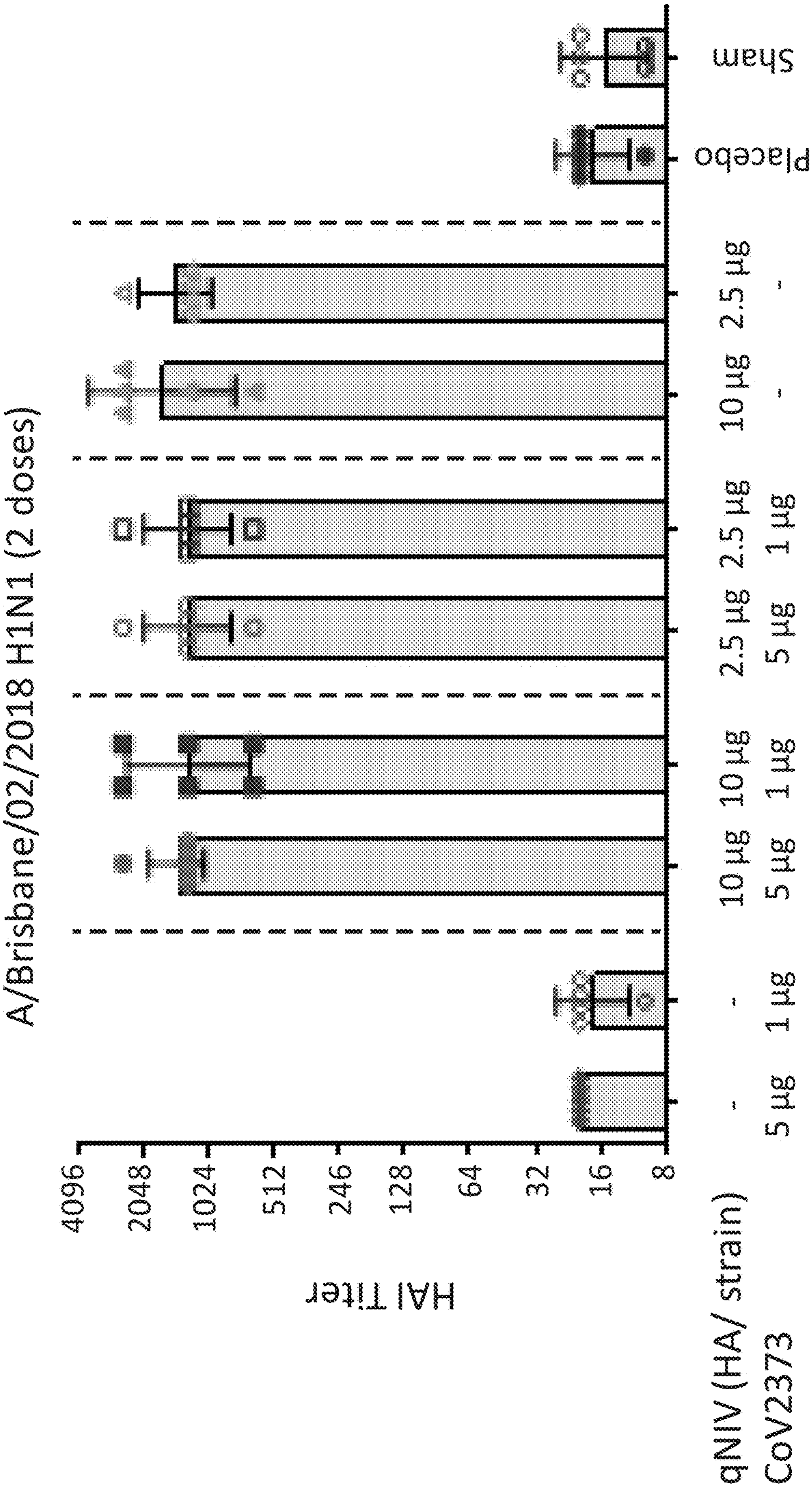
Figure 10E:
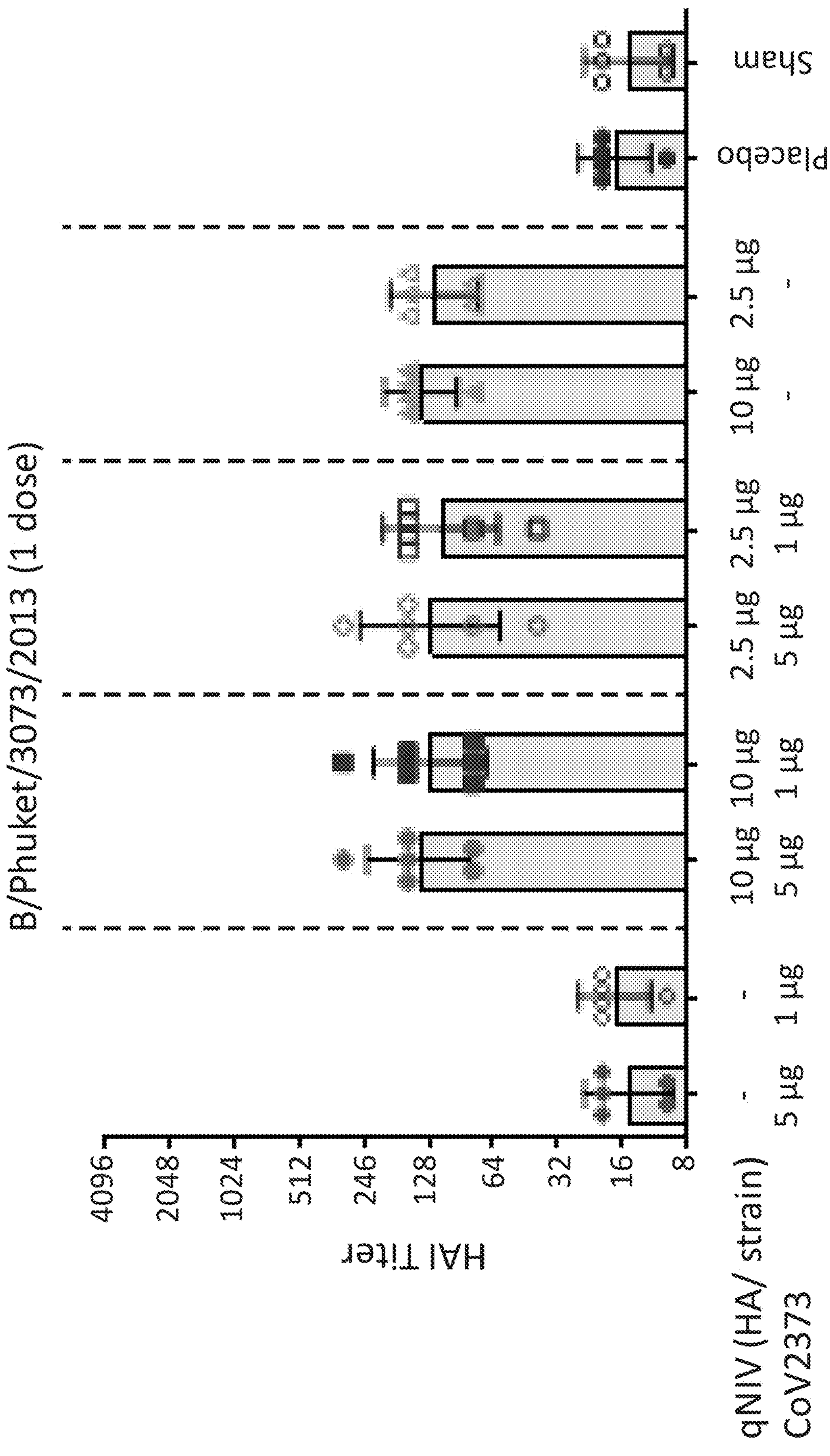
Figure 10F:
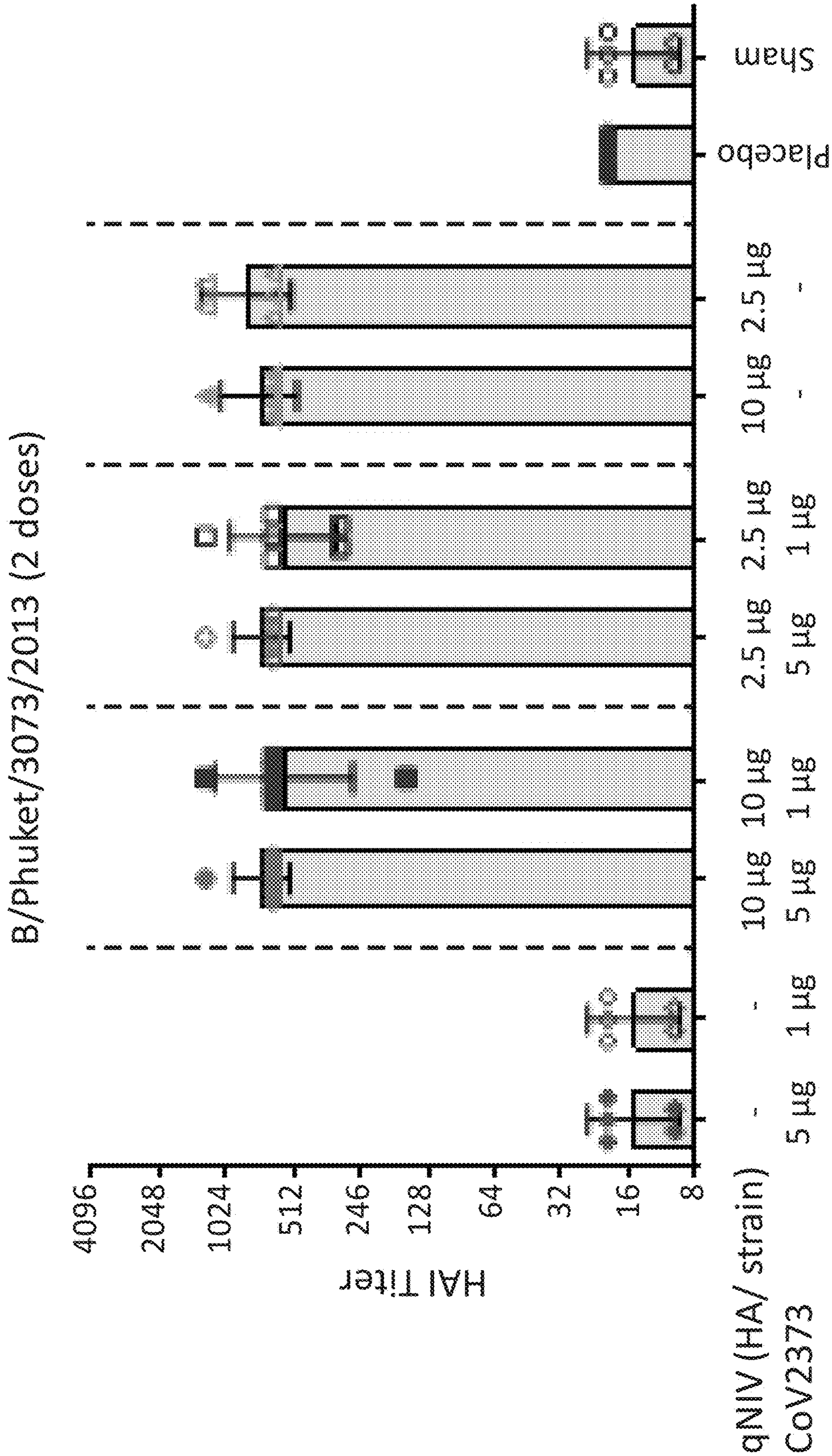
Figure 10G:
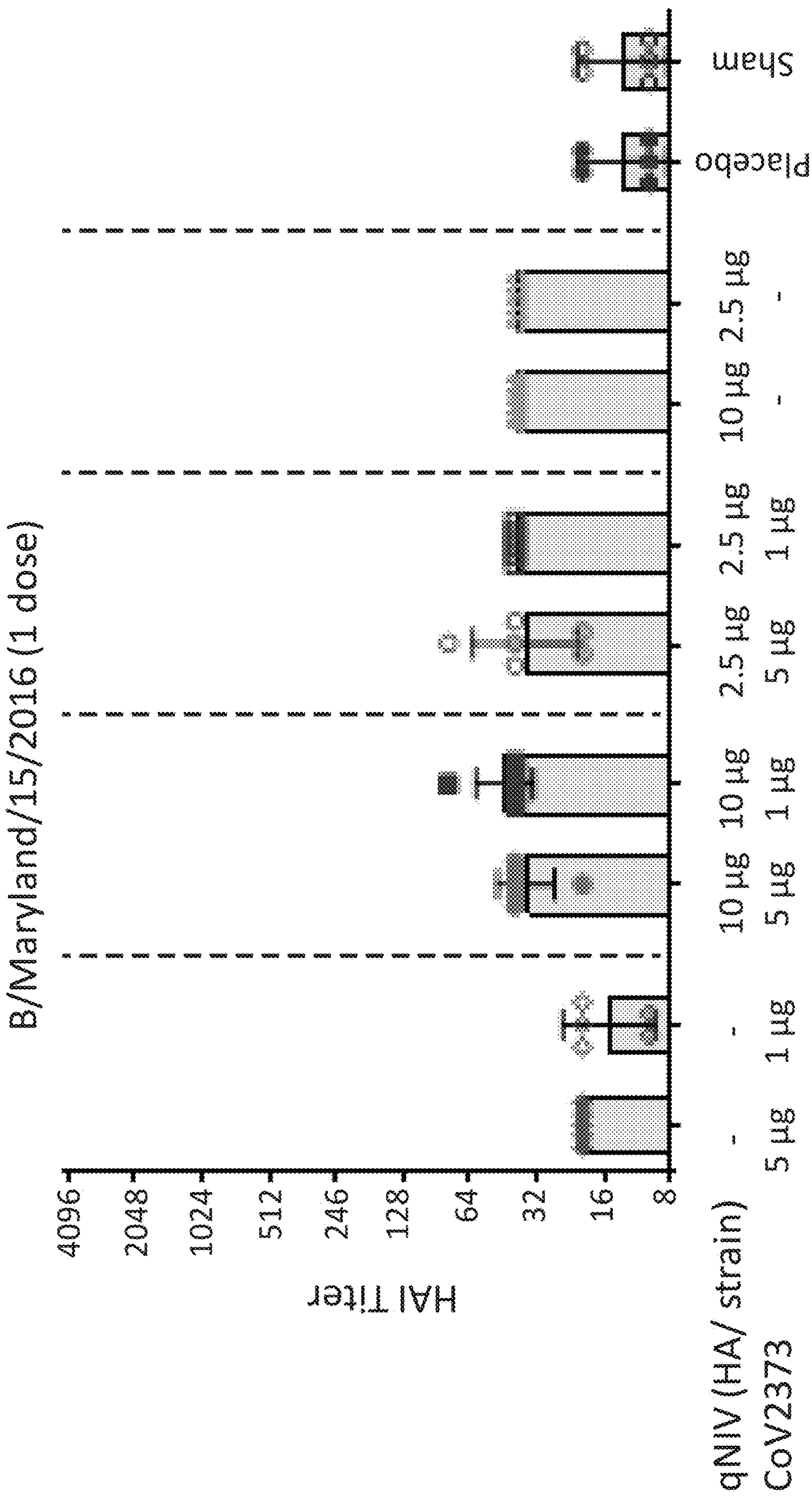
Figure 10H:
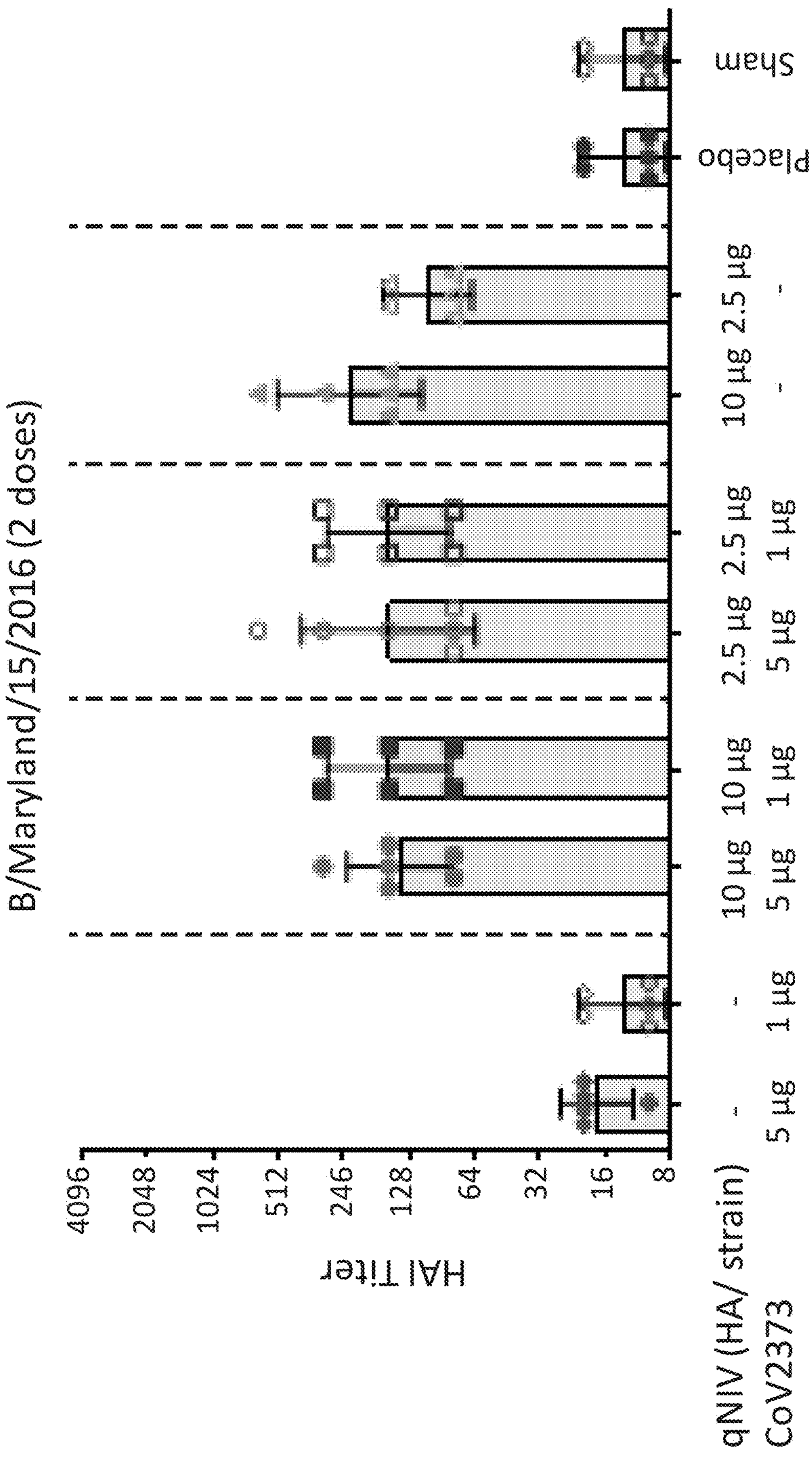
Figure 11A:
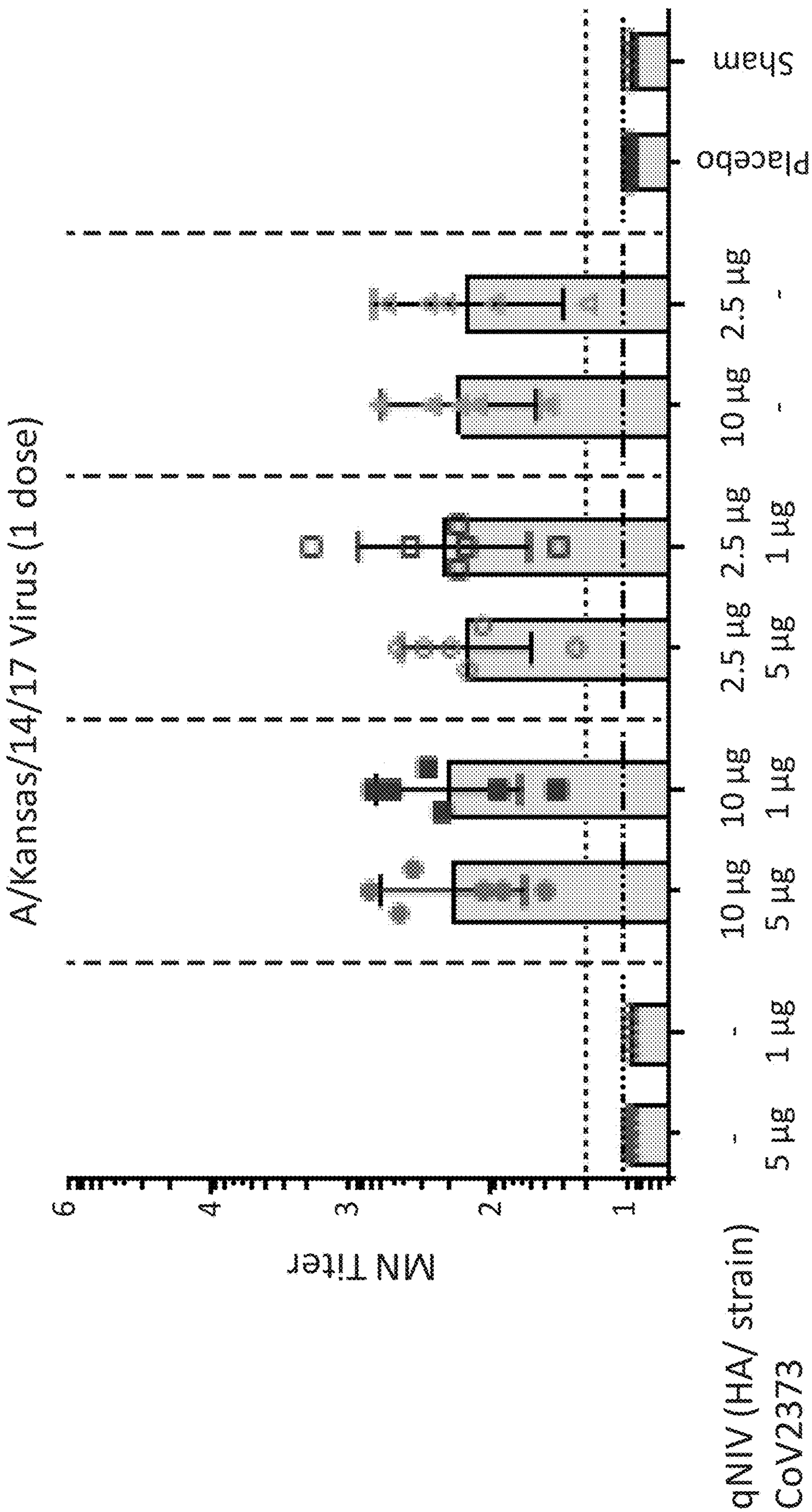
FIGS. 11A-11H show influenza virus neutralizing antibodies in hamsters immunized with qNIV/CoV2373 combination vaccine. Groups of hamsters were immunized with the combination qNIV/CoV2373 or with the component vaccines as indicated in FIG. 8A. Virus neutralizing titers were determined 14 days after 1 dose and 14 days after the booster immunization (study day 28) in response to A/Kansas/14/2017 (FIG. 11A, FIG. 11B, A/Brisbane./02/2018 (FIG. 11C, FIG. 11D), B/Phuket/3073/2013 (FIG. 11E, FIG. 11F), and B/Maryland/15/2016 (FIG. 11G, FIG. 11H). Bars indicate the geometric mean titer (GMT) and error bars indicate the 95% confidence interval. Horizontal dashed line indicates the limit of detection (LOD).
Figure 11B:
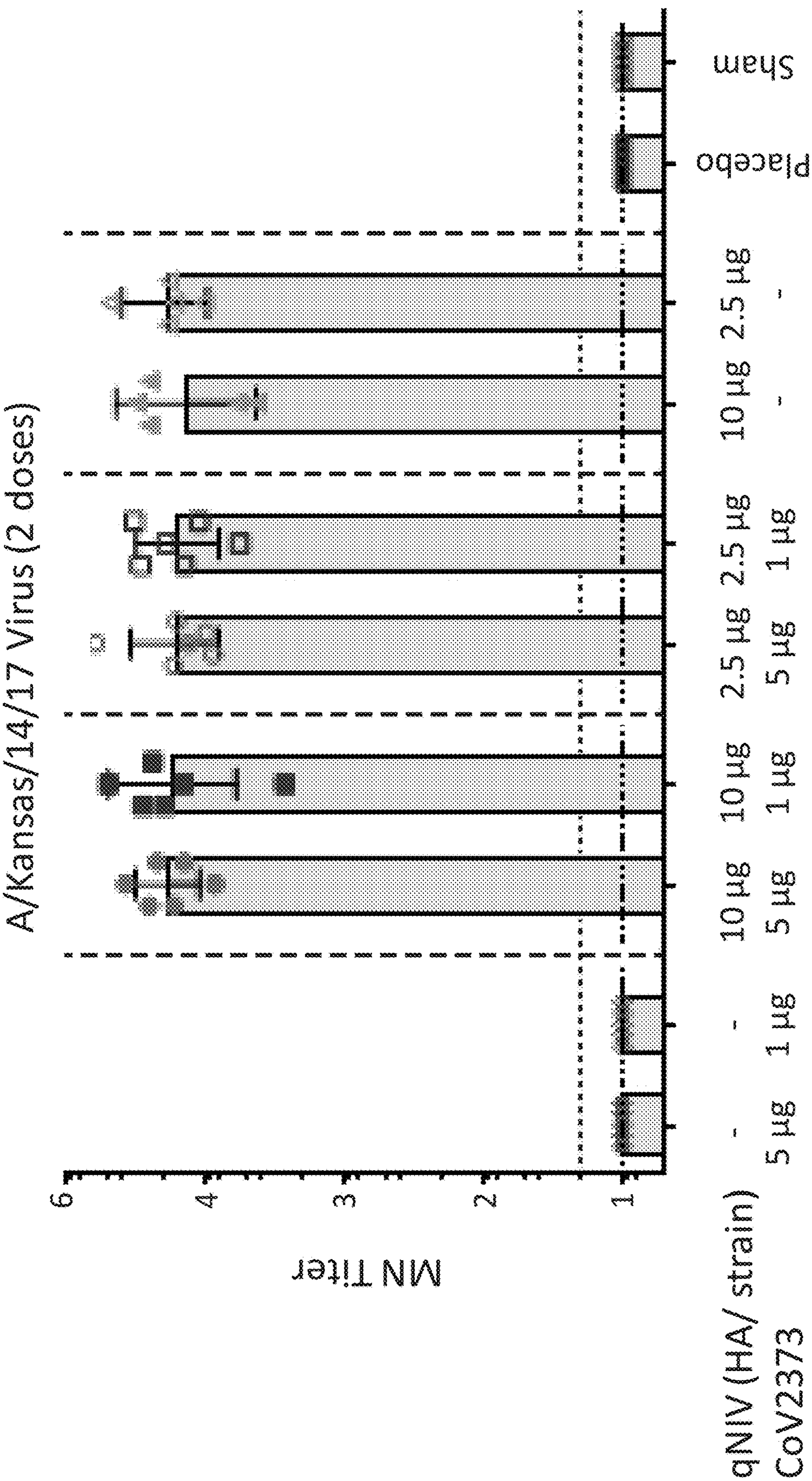
Figure 11C:
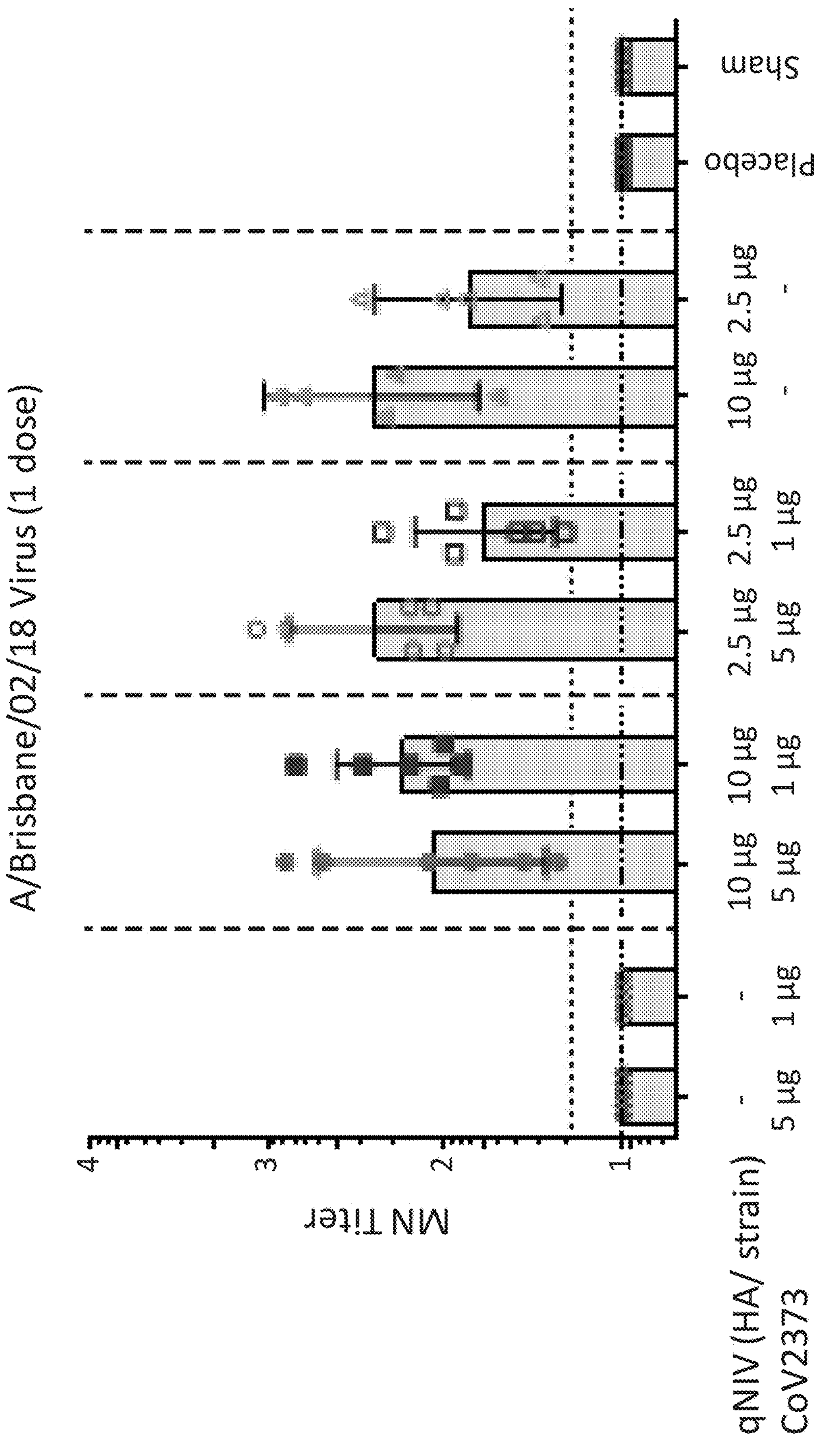
Figure 11D:
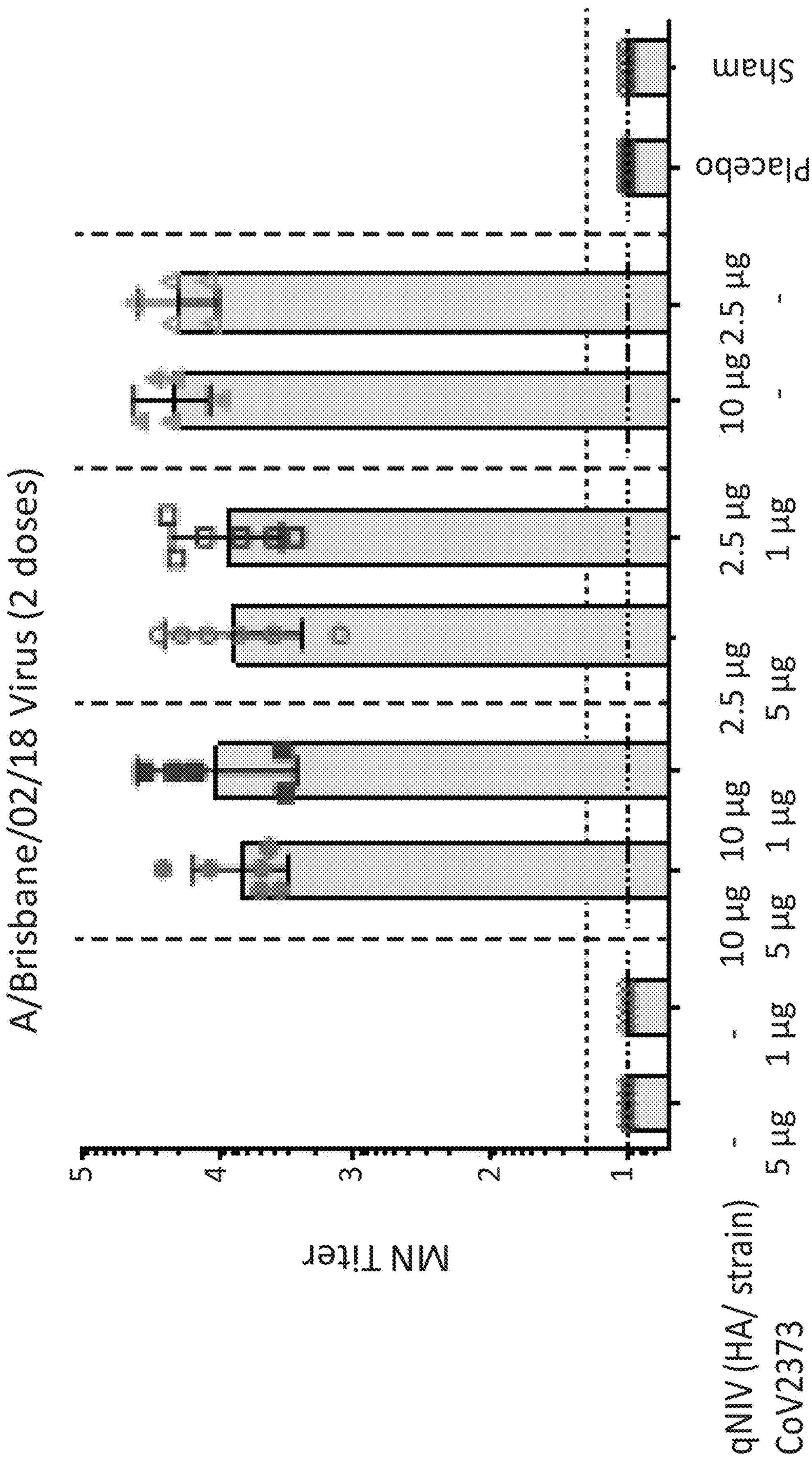
Figure 11E:
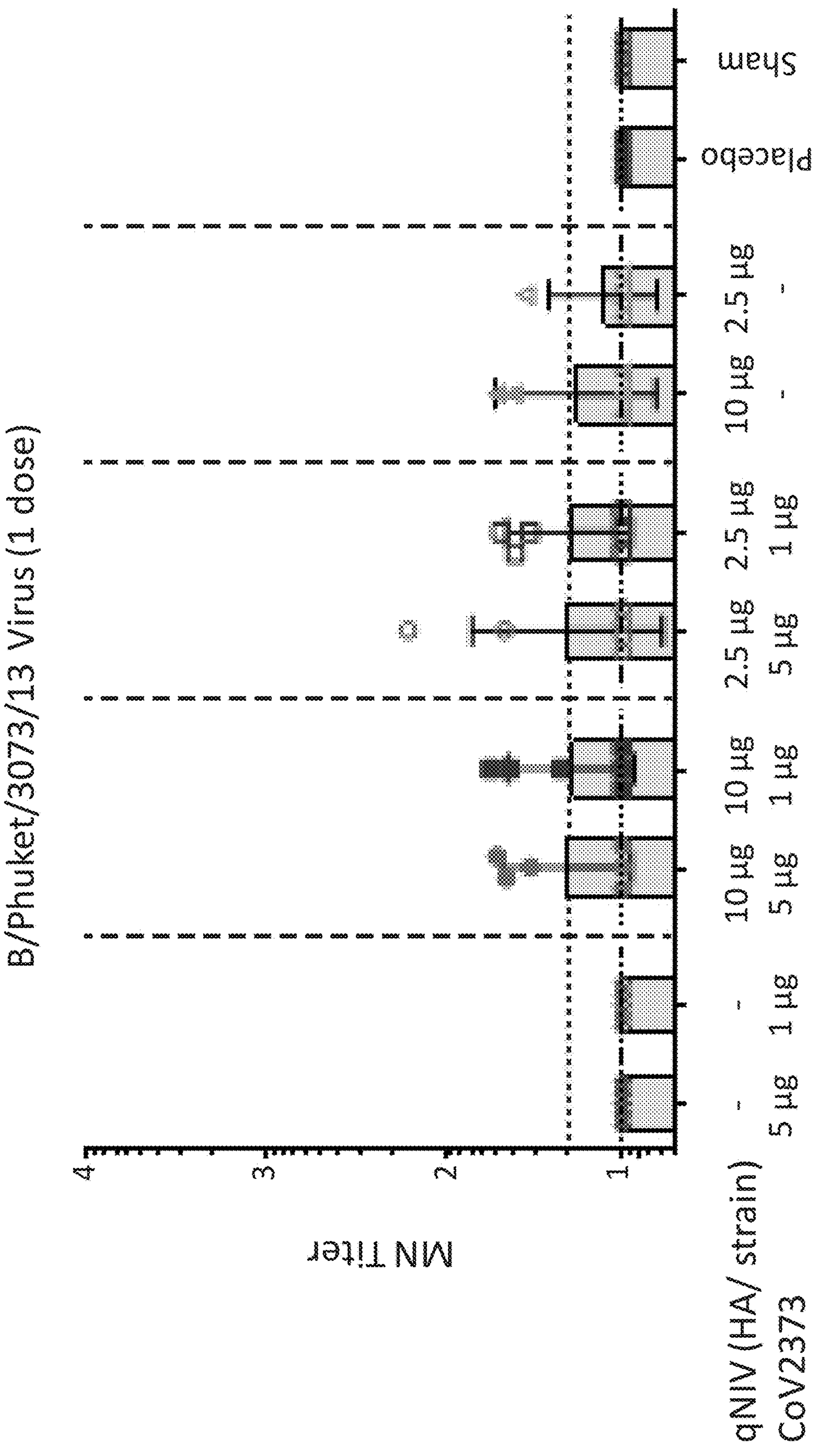
Figure 11F:
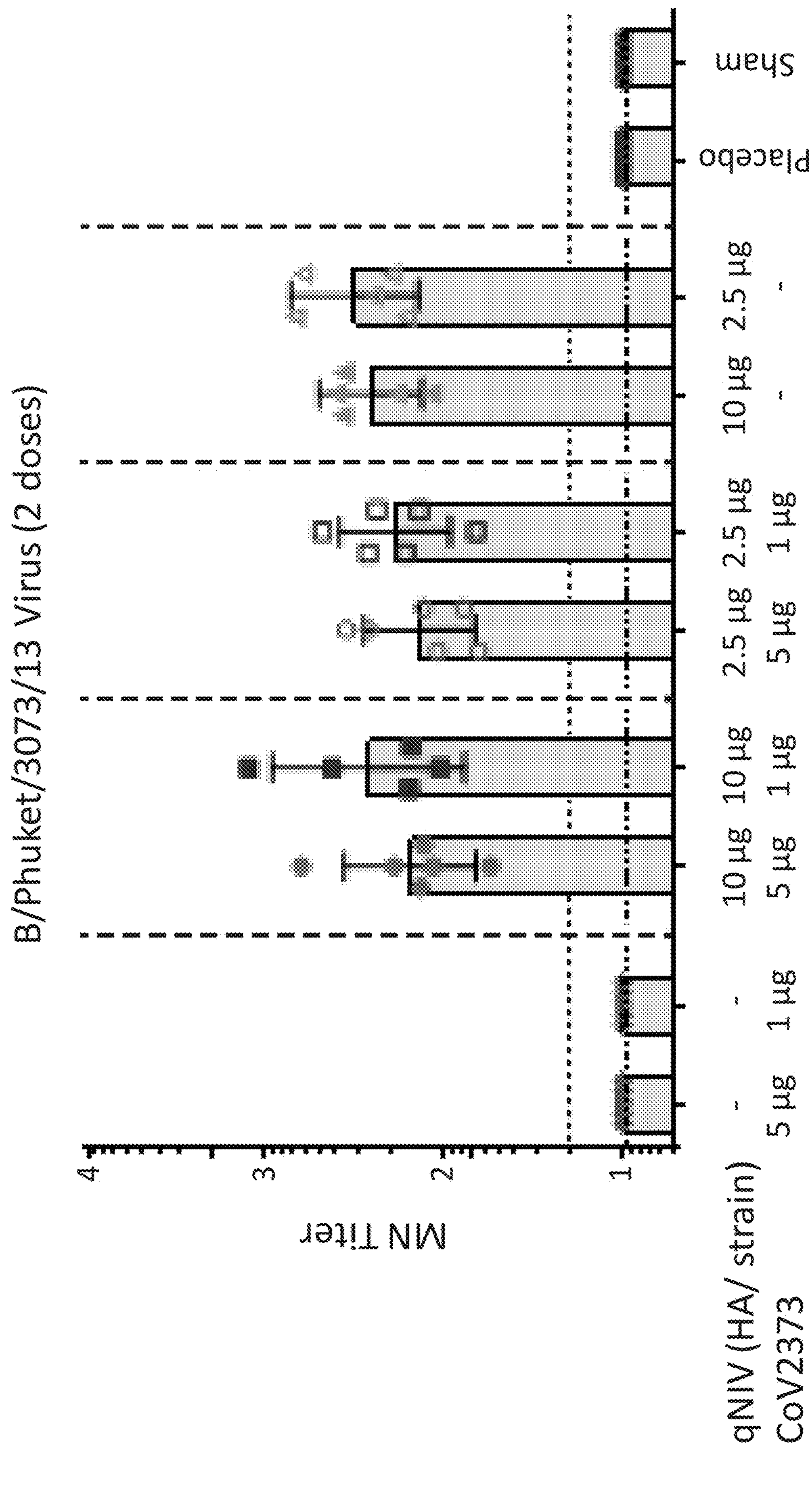
Figure 11G:
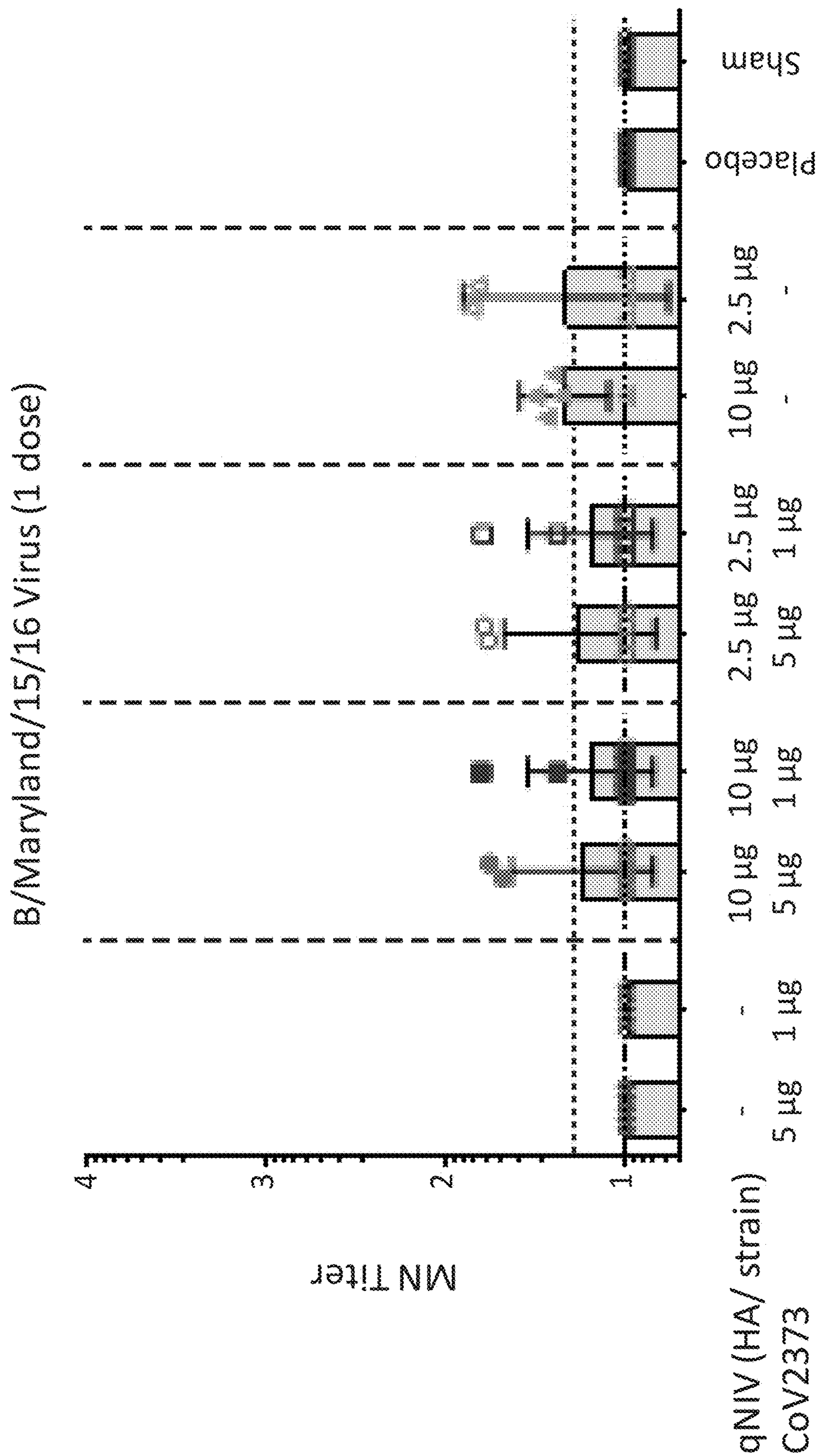
Figure 11H:
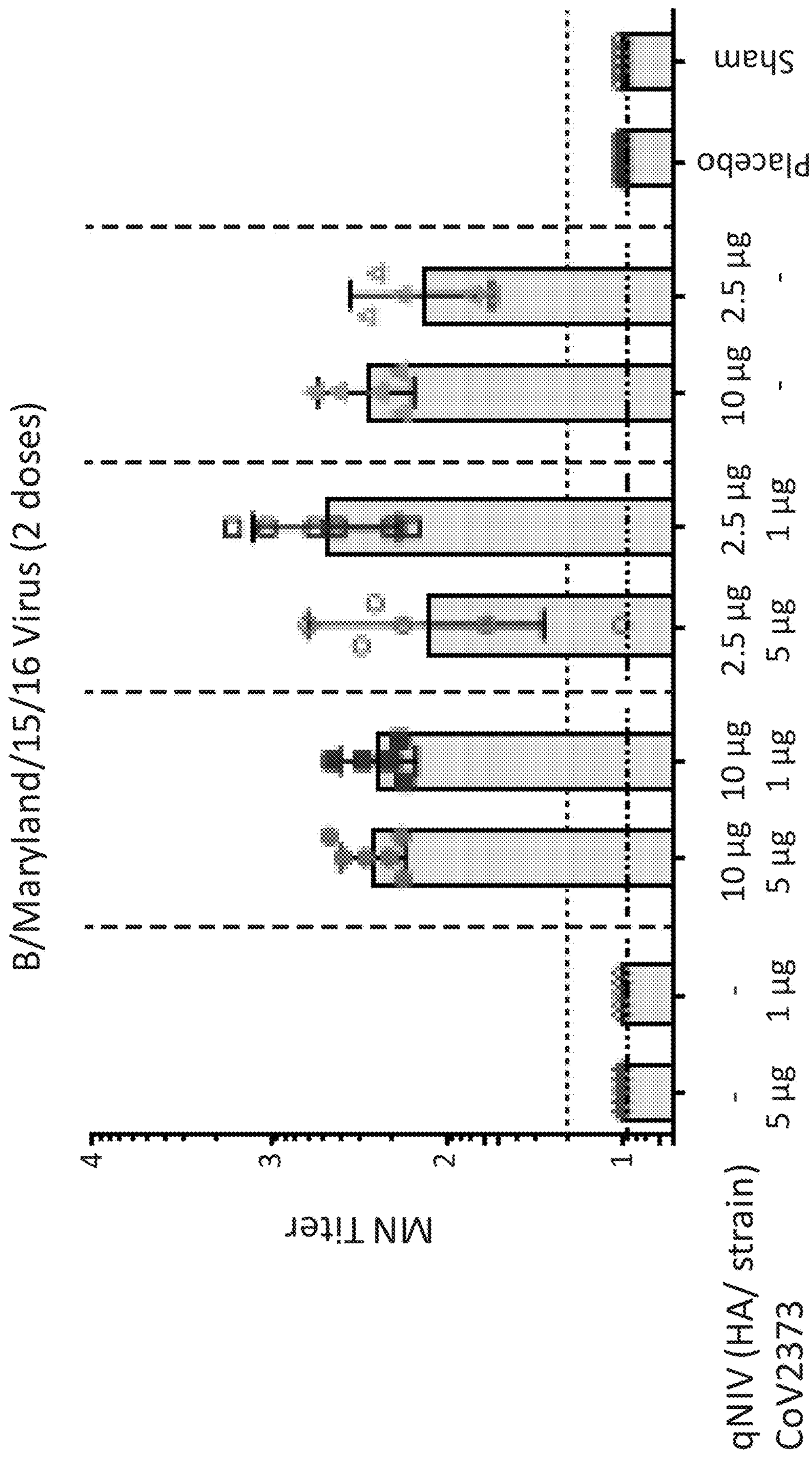

The immune responses to influenza A and B strains elicited by qNIV/CoV2373 were compared to immunization with qNIV. Hamsters immunized with the combination vaccine had high HAI titers to A/Kansas H3N2 (GMT=113–202) and A/Brisbane H1N1 (GMT=143–226) after a single immunization. A/Kansas H3N2 HAI titers increased 6.3-14.2-fold (GMT=1280–1810) following the booster immunization and A/Brisbane H1N1 HAI titers increased 5.7-10-fold (GMT=1280–1437) following the booster. (FIGS. 10A-D). Animals immunized with qNIV had equivalent HAI titers to the A strains. A/Kansas (GMT=80–106) and A/Brisbane (GMT=121–211) after a single immunization. A/Kansas HAI titer increased 24-fold (GMT=1940–2560) and A/Brisbane HAI titer increased 8-12.1-fold (GMT 1470–1689) after the booster immunization. Animals immunized with the combination vaccine had elevated HAI titers to B/Phuket after as single immunization (GMT=80–143) that increased 5-9-fold (GMT=570–718) following the second immunization. Animals receiving a single immunization with qNIV had comparable B/Phuket HAI titers (GMT=735–844) after the prime/boost immunization (FIG. 10E, FIG. 10F). Likewise, animals immunized twice with the qNIV/CoV2373 had similar HAI titers to B/Maryland (GMT=160–142), which was equal to HAI titers elicited by immunization with the qNIV (GMT=106–242) (FIG. 10G, FIG. 10H).

Virus neutralizing antibody titers were comparable between groups of hamsters immunized with qNIV/CoV2373 compared to animals immunized with the qNIV alone. Animals immunized with a prime/boost with qNIV/CoV2373 had high neutralizing titers to A/Kansas (GMT=15,693–16,916) and A/Brisbane (GMT=6992–10,507). Immunization with qNIV elicited similar neutralizing titers to A/Kansas (GMT=13,625–19,314) and A/Brisbane (GMT=20,146–22,146) (FIGS. 11A-D). Similarly, animals immunized with qNIV/CoV2373 or with qNIV had comparable levels of B strain neutralizing titers (FIGS. 11E-H). Taken as a whole, these results indicate that the qNIV/CoV2373 combination vaccine was immunogenically equivalent to the qNIV and monovalent CoV2373 comparators, indicating there was no interference in the immune responses when qNIV and CoV2373 were co-administered with saponin adjuvant.

Competitive Polyclonal RBD Antibodies Against Neutralizing mAbs

Figure 12A:
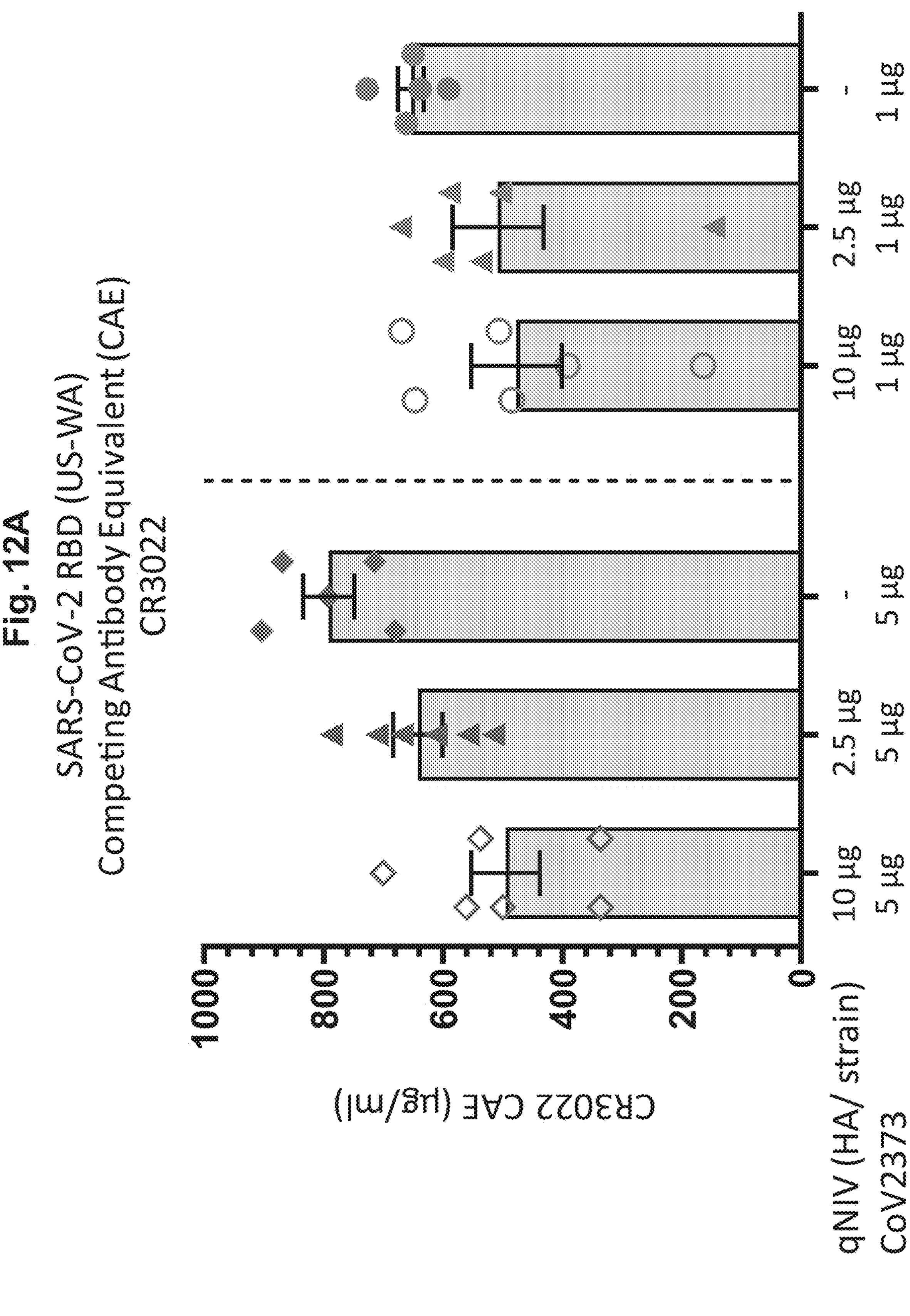
FIGS. 12A-12E show that the combination qNIV/CoV2373 vaccine elicits antibodies that bind highly conserved cryptic epitopes in the receptor-binding domain (RBD) of SARS-CoV-2 determined by biolayer interferometry (BLI). The specificity of antibodies elicited by qNIV/CoV2373 combination or monovalent CoV2373 was determined by competitive antibody binding of immune serum with receptor site-specific neutralizing monoclonal antibodies by BLI. Horizontal bars indicate the group geometric mean and the error bars indicate the 95% confidence interval. Colored symbols indicate Individual animal values.
Figure 12B:
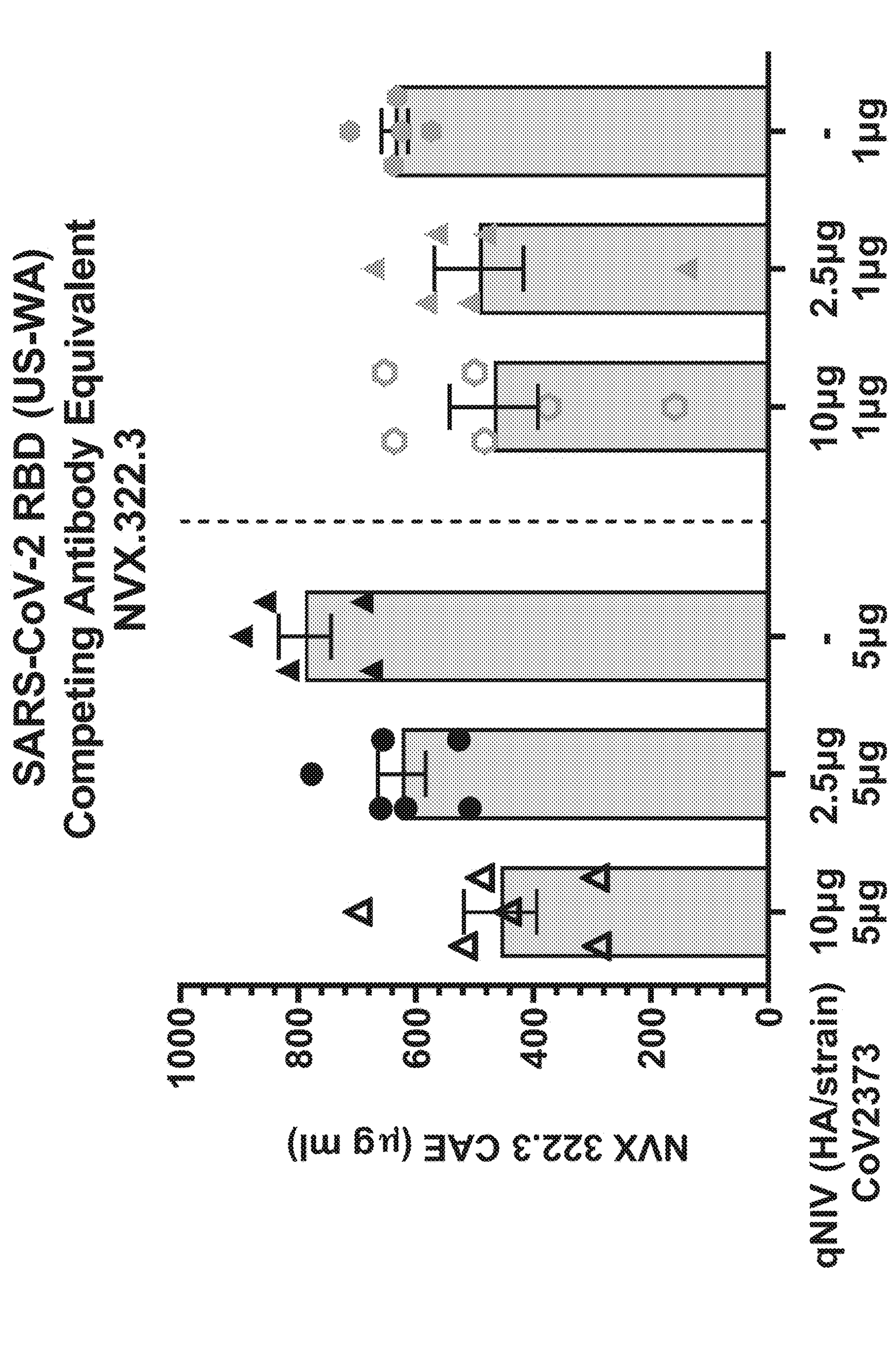
Figure 12C:
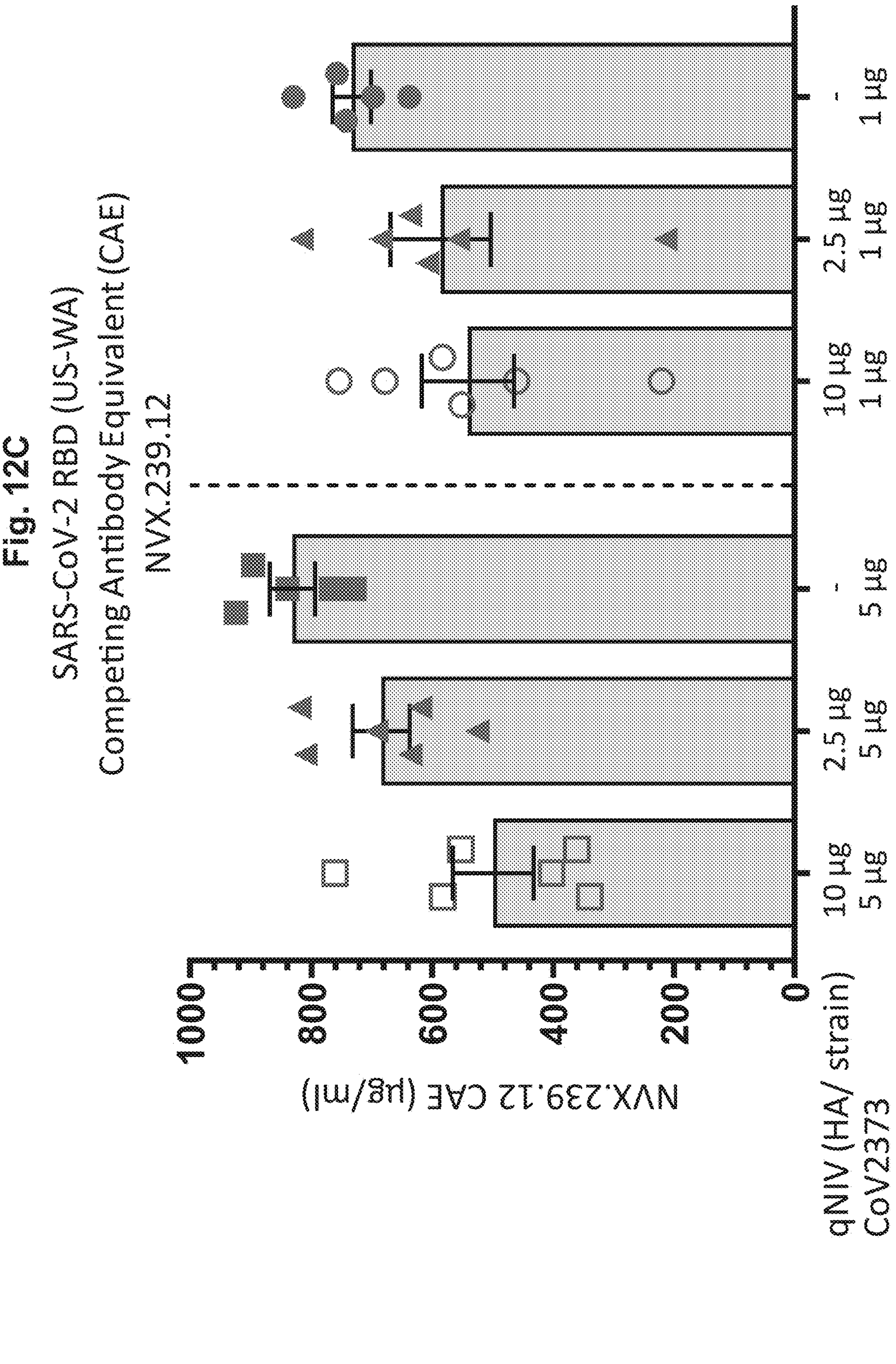

Polyclonal antibodies were induced in hamsters competitive with prototype US-WA spike RBD neutralizing mAbs CR3022, NVX.322.3 and NVX.239.12 (Table 3) regardless of vaccination with monovalent CoV2373 or combination qNIV. Hamsters immunized with monovalent CoV2373 had significantly higher polyclonal antibodies competitive against the US-WA RBD mAbs when immunized with 5 μg versus 1 μg monovalent CoV2373 (FIGS. 12A-C).

TABLE 3

Functional characteristics of SARS-CoV-2 Spike monoclonal antibodies

| Antibody | Isotope | SARS-CoV-2 spike binding ($EC_{50}$, ng/mL) | SARS-CoV-2 spike RBD[a] ($EC_{50}$, ng/mL) | ACE2[b] receptor inhibition ($IC_{50}$, ng/mL) | 100% SARS-CoV-2 neutralization ($IC_{100}$, ng/mL) |
|---|---|---|---|---|---|
| NVX 239.12 | IgG1/kappa | 7 | 32 | 56 | 12.35 |
| NVX 322.03 | IgG1/kappa | 28 | 250 | 275 | 185 |

Figure 12D:
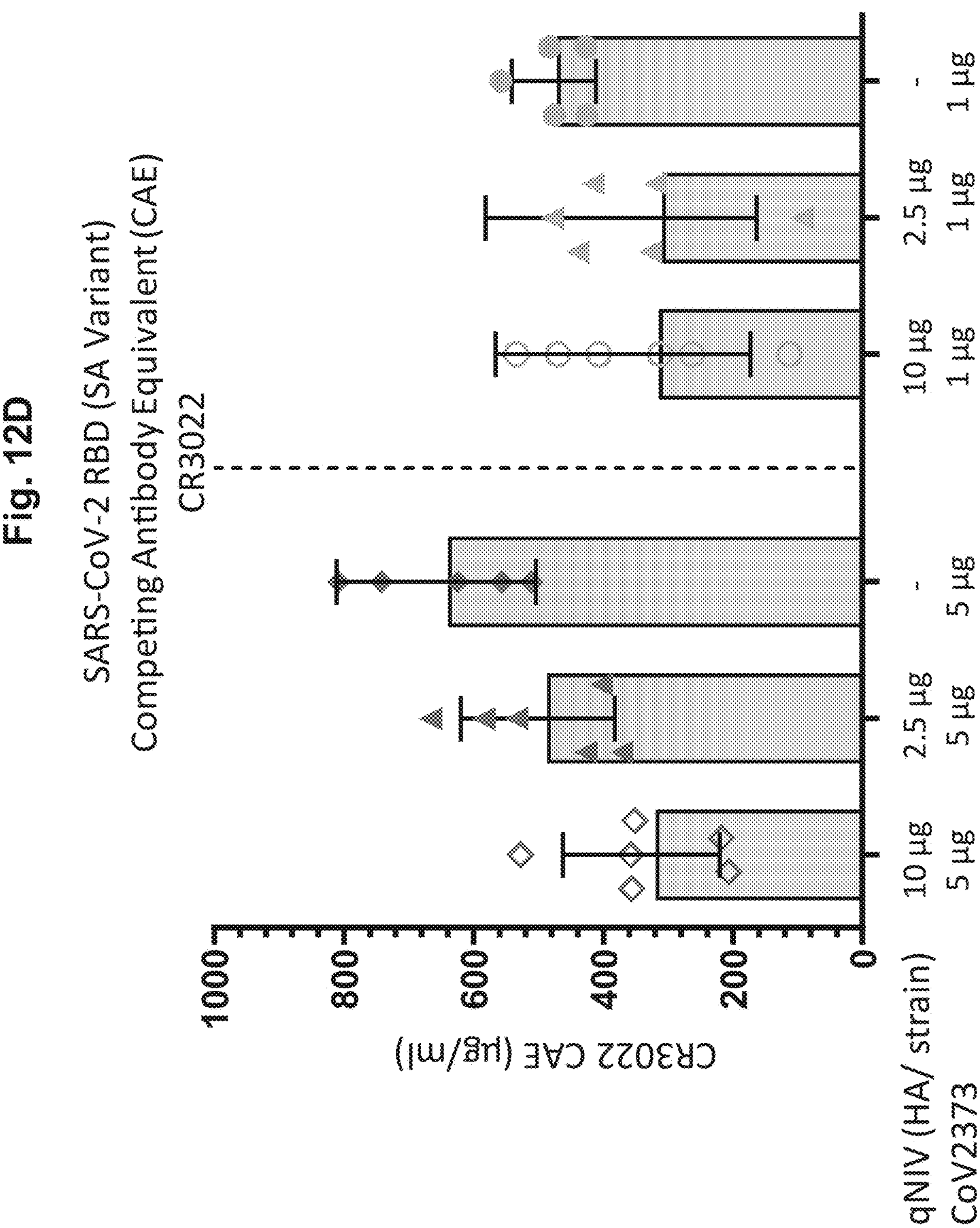
Figure 12E:
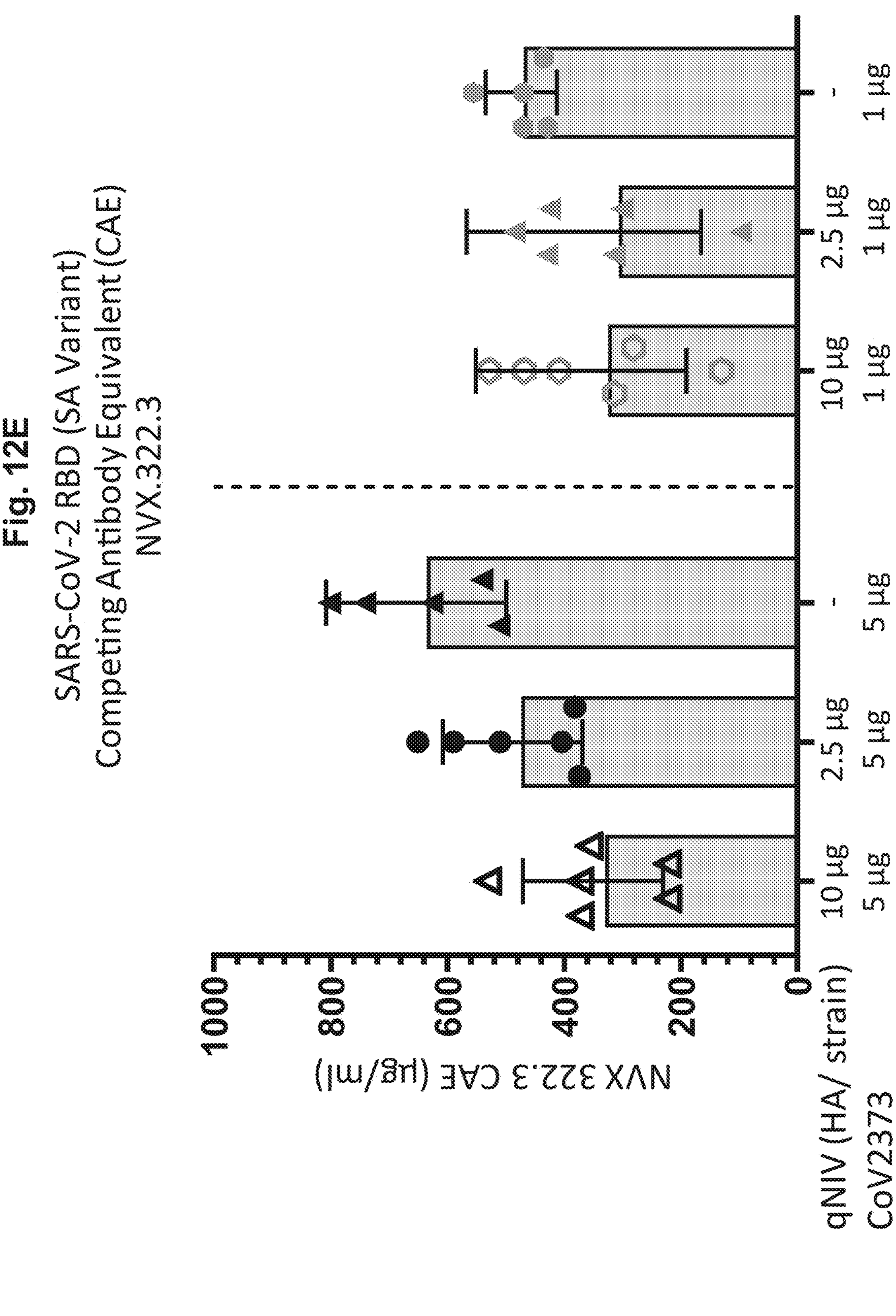

[a]RBD: receptor binding domain
[b]ACE2: angiotensin-converting enzyme 2 receptor The combination of qNIV with 1 μg or 5 μg of CoV2373 rS resulted in some reduction in the levels of competitive polyclonal antibodies measured against the US-WA RBD. A similar pattern of competitive polyclonal antibody responses against the B.1.351 variant were induced in hamsters immunized with monovalent CoV2373 and qNIV/CoV2373 combination vaccines. However, monovalent CoV2373 or the combination vaccine with qNIV induced significant polyclonal antibodies competitive with CR3002 and NVX.322.3 (FIGS. 12D-E). NVX-239.12 did not bind by to the B.1.351 variant RBD.

Post Challenge Clinical Signals

Figure 13A:
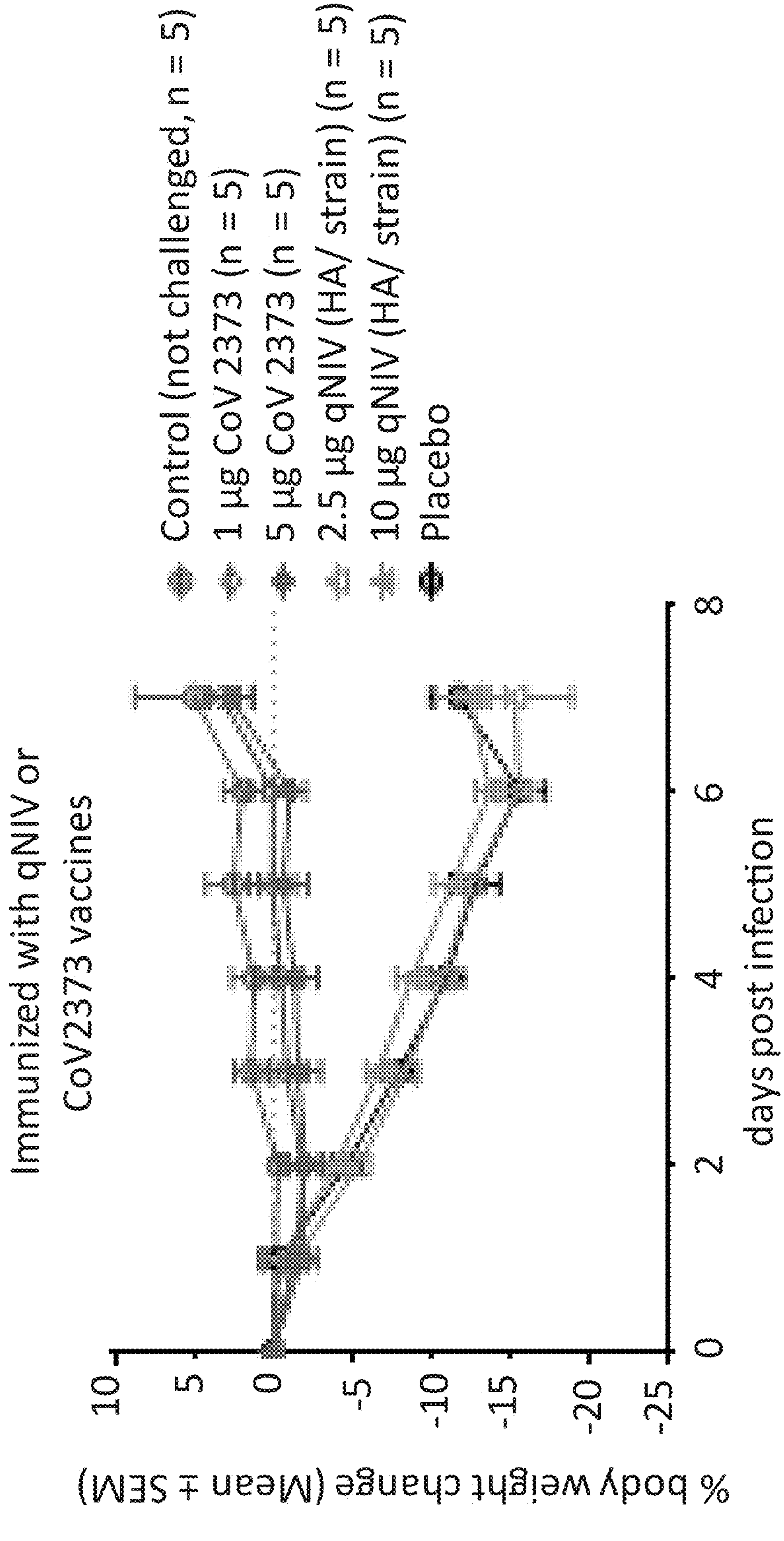
FIGS. 13A-13G show the weight change and protection against upper and lower respiratory infection with SARS-CoV-2 in hamsters immunized with qNIV/CoV2373 combination vaccine. Groups of male and female hamsters (n=5-6/group) were immunized with a prime/boost regimen of qNIV/CoV2373 or the component vaccines spaced 14 days apart. Three weeks after the second immunization (study day 35), animals were challenge by the intranasal route with 2.0×10' pfu.
Figure 13B:
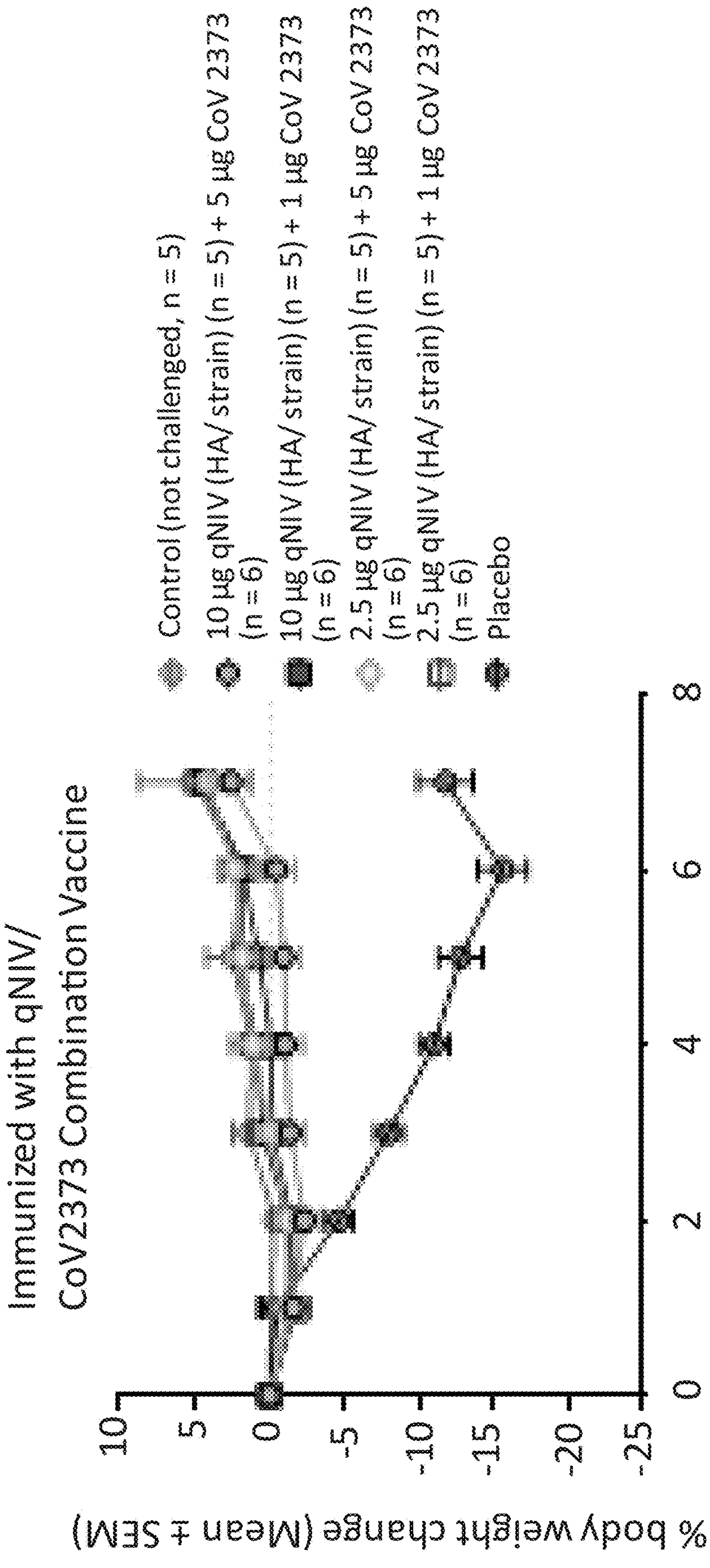

To assess the protective efficacy of the combination vaccine, immunized and placebo treated hamsters were challenged with SARS-CoV-2 by the intranasal route 21 days after the second immunization (study day 35) by the intranasal route with SARS-CoV-2. All animals survived the post challenge phase until the scheduled necropsy (7 dpi). Animal weights were monitored daily throughout the post challenge period. Animals receiving the placebo or immunized with the qNIV (2.5 μg or 10 μg HA/strain) lost 12.5% to 15% body weight by 7 dpi. In contrast, animals immunized with 1 μg or 5 μg CoV2373 retained their weight with a 2.6% to 5% gain in weight at 7 dpi (FIG. 13A). Animals immunized with qNIV/CoV2373 retained their weight with a 2.5% to 5% gain in weight at 7 dpi, which was the same as the non-infected sham group (FIG. 13B).

Figure 13C:
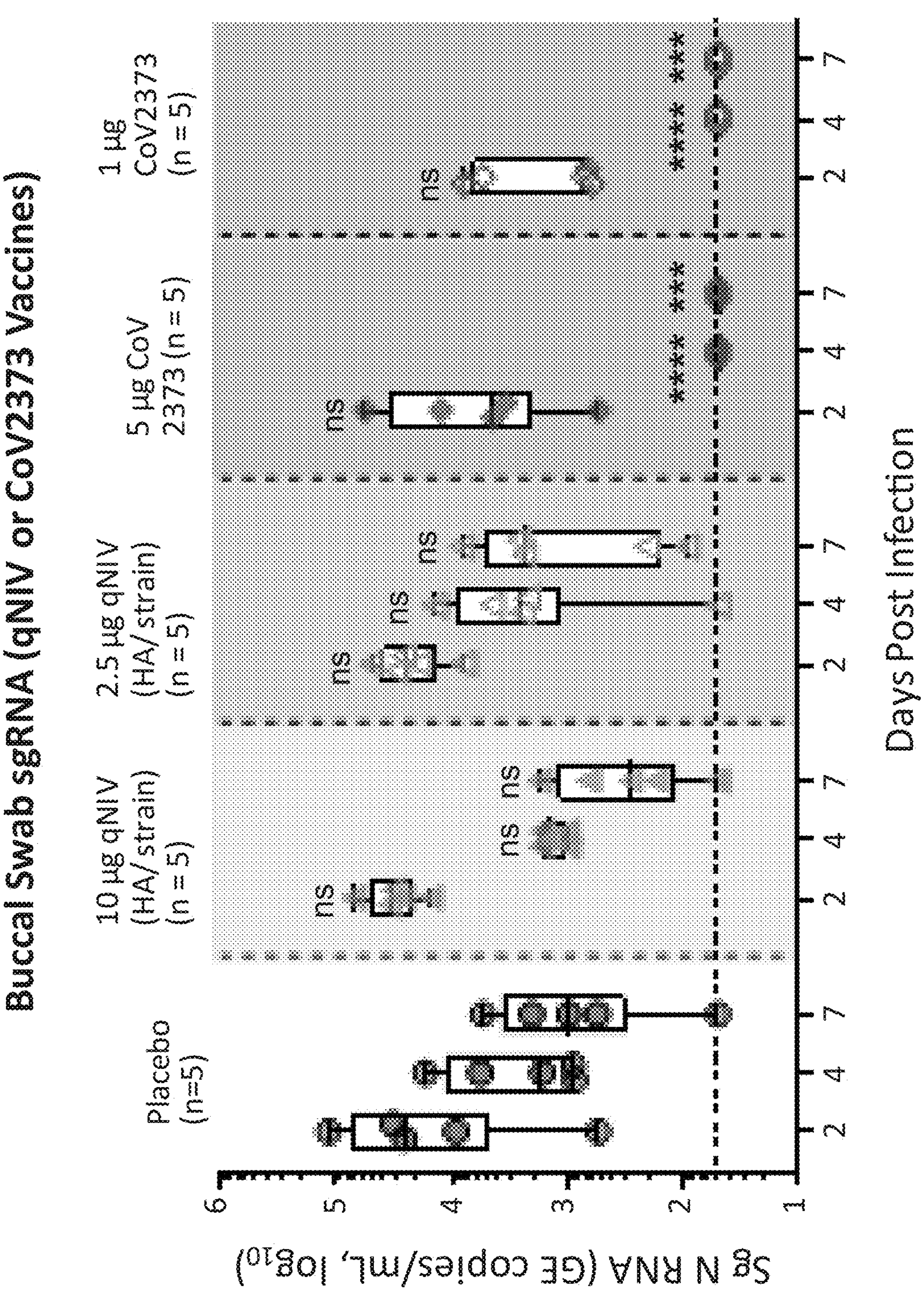
Figure 13D:
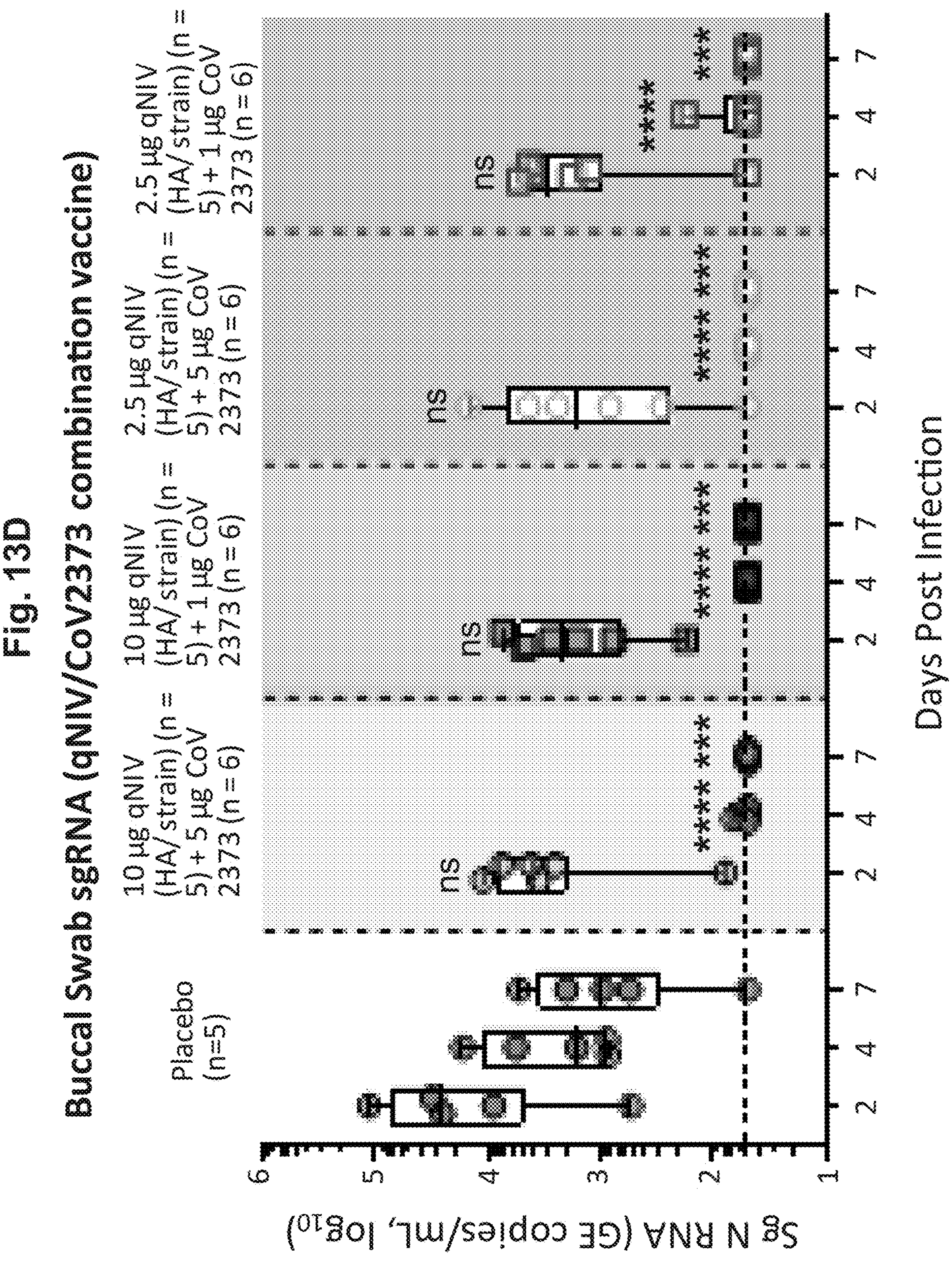

Subgenomic Virus mRNA in Oral Swabs, Bronchoalveolar Lavage (BAL), and Lung Samples To examine the efficacy of the qNIV/CoV2373 vaccine, virus load in the upper and lower respiratory tract was determined using qRT-PCR designed to detect SARS-CoV-2 subgenomic (sg) SARS-CoV-2 nucleocapsid (N) RNA. Oral swabs were collected 2, 4, and 7 days post infection (dpi). The highest levels of sgRNA were observed in oral swabs of placebo treated animals with a median peak of 4.4 (range 2.7-5.1) $log_{10}$ RNA copies $mL^{-1}$ at 2 dpi. Viral levels remained elevated at 3.2 (range 2.9-4.2) $log_{10}$ RNA copies $mL^{-1}$ at 4 dpi and declined to 3.0 $log_{10}$ (range 1.7-3.7) RNA copies $mL^{-1}$ at 7 dpi. Viral RNA levels were not significantly different in oral swabs from animals immunized with 10 μg or 2.5 μg HA/strain with the highest levels of sgRNA of 4.4-4.5 (range 3.9-4.9) $log_{10}$ RNA copies $mL^1$ at 2 dpi, 3.2-3.4 (range 1.7-3.7) $log_{10}$ RNA copies $mL^{-1}$ at 4 dpi, and 2.5-3.4 (1.7-3.9) $log_{10}$ RNA copies $mL^{-1}$ at 7 dpi. Oral swabs from animals immunized with 5 μg or 1 μg CoV2373 had detectable viral RNA at 2 dpi (2.9-3.6 $log_{10}$ copies $mL^{-1}$). No viral RNA was detected in swabs of animals immunized with CoV2373 at 4 or 7 dpi (FIG. 13C). Viral RNA (3.2-3.5 $log_{10}$ RNA copies $mL^{-1}$) was detected only in swabs collected 2 dpi in animals immunized with qNIV/CoV2373, while no replicating virus was detected at 4 or 7 dpi (FIG. 13D).

Figure 13E:
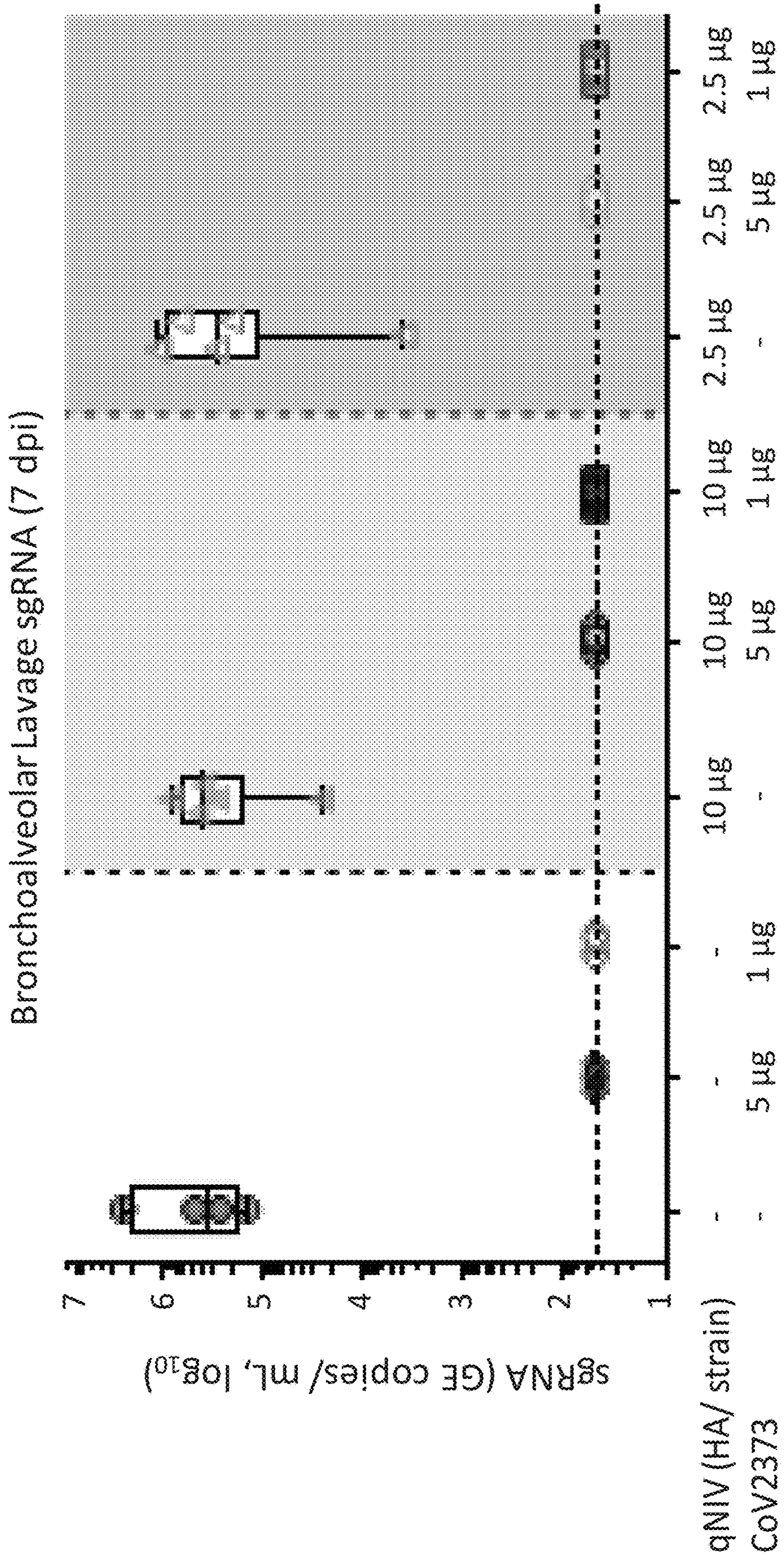

BAL washes were obtained at necropsy and analyzed for viral RNA. The placebo group and the groups immunized with 10 μg or 2.5 μg HA/strain had the highest median levels of viral RNA. Aspirates from the placebo group had the levels of replicating virus with a median of 5.6 (range 5.1-6.4) $log_{10}$ sgRNA copies $mL^{-1}$. Virus load in BAL was also high in animals immunized with 10 μg HA/strain with a median of 5.6 (range 4.4-5.9) $log_{10}$ RNA copies mL- and 2.5 μg HA/strain with a median of 5.5 (range 3.6-6.0) $log_{10}$ RNA copies $mL^1$. Little or no viral RNA was detected in BAL samples obtained from animals immunized with CoV2373 (1 μg or 5 μg) or with the qNIV/CoV2373 combination (FIG. 13E).

Figure 13F:
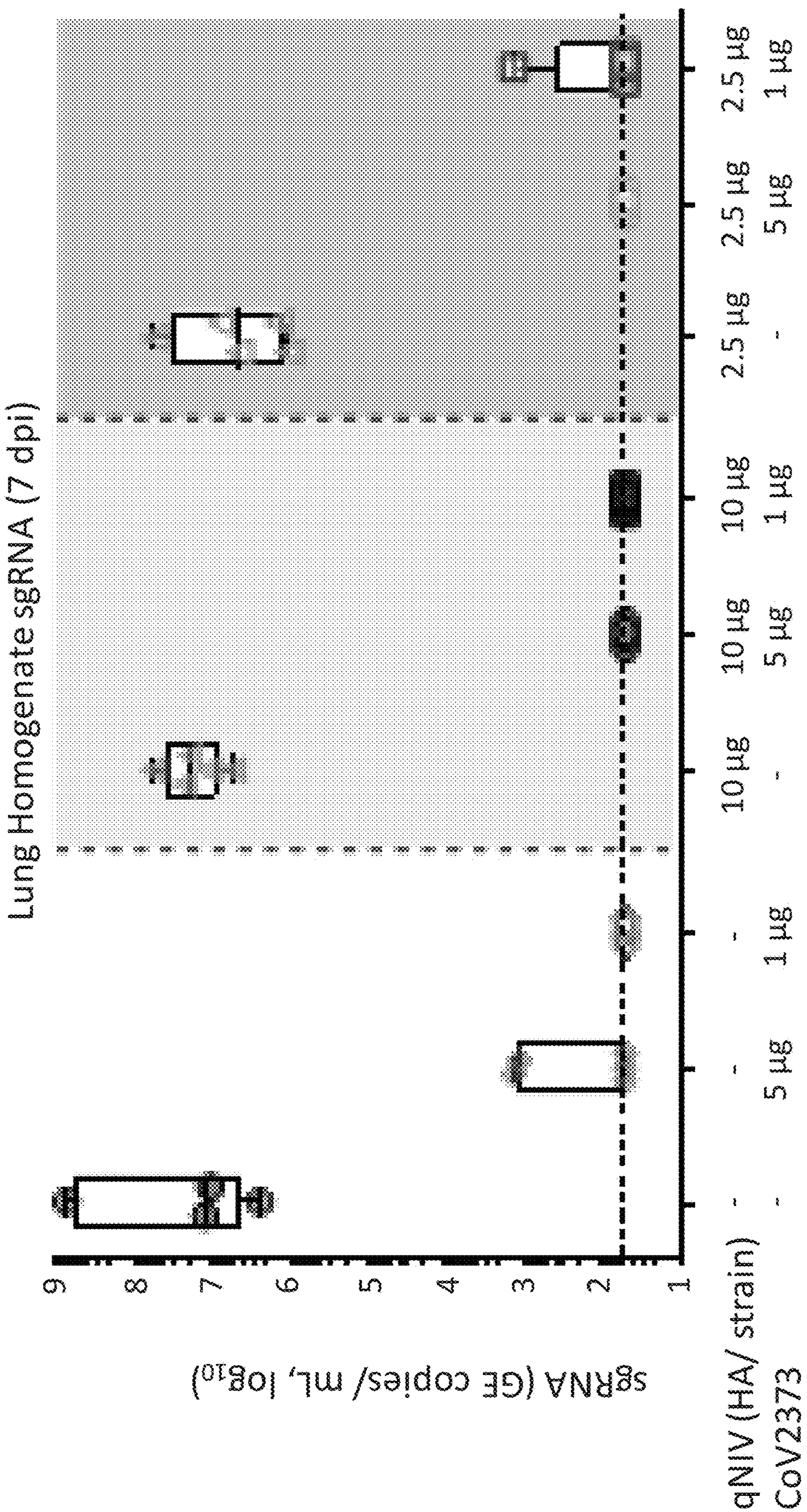

Lung tissues collected at necropsy and were evaluated for virus load. Lung homogenates from placebo treated and animals receiving qNIV had the highest virus load: placebo median 7.1 (range 6.4-8.9) $log_{10}$ RNA copies gram-; 10 μg HA/strain 7.3 (range 6.7-7.8) $log_{10}$ RNA copies $gram^{-1}$; and 2.5 μg HA/strain 6.7 (range 6.0-7.7) $log_{10}$ RNA copies grami. Lung homogenates from animals immunized with CoV2373 or the qNIV/CoV2373 combination had little or no detectable virus (FIG. 13F).

Figure 13G:
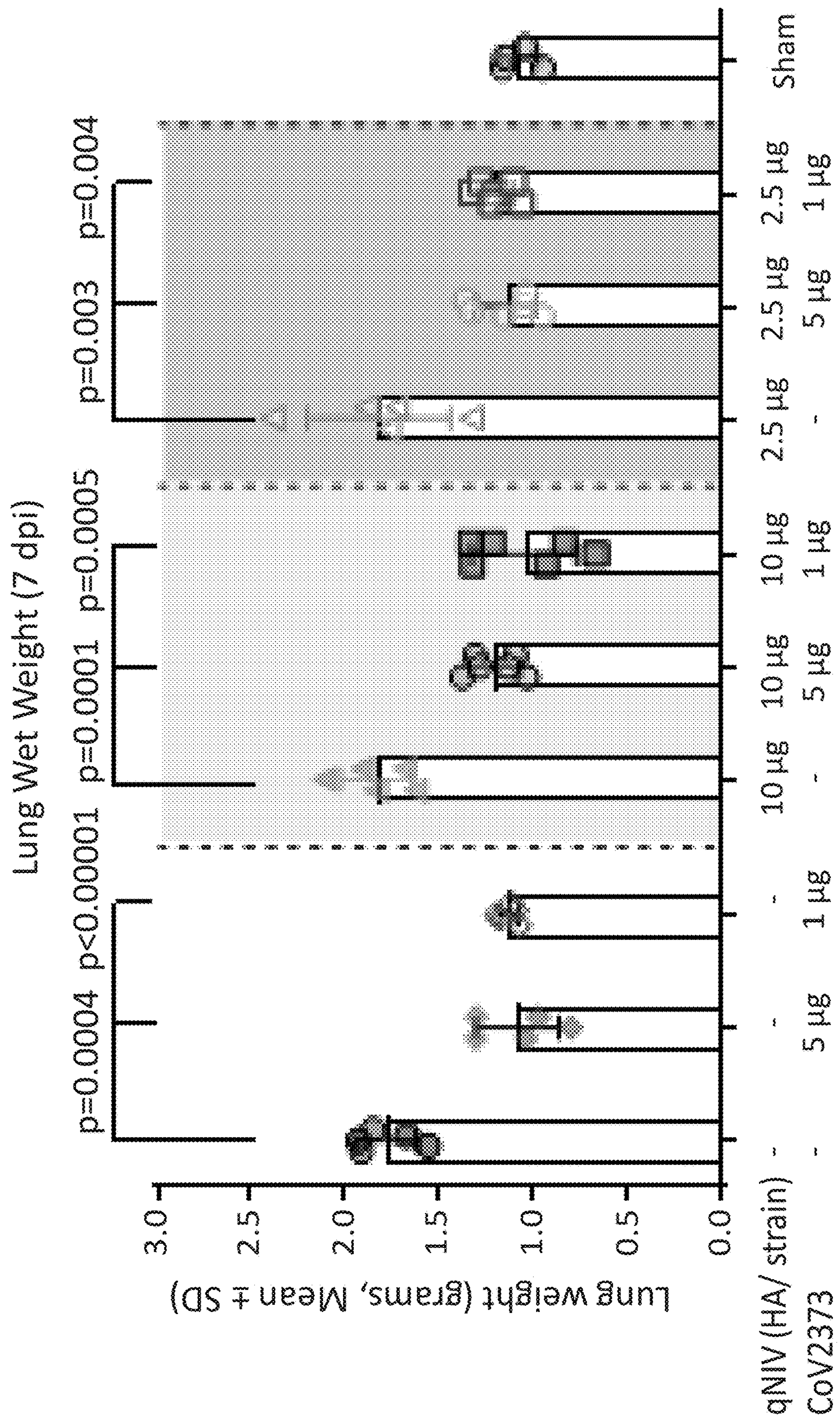
Figures 14A, 14B, 14C, 14D, 14E, 14F, 14G, 14H, 14I, 14J:
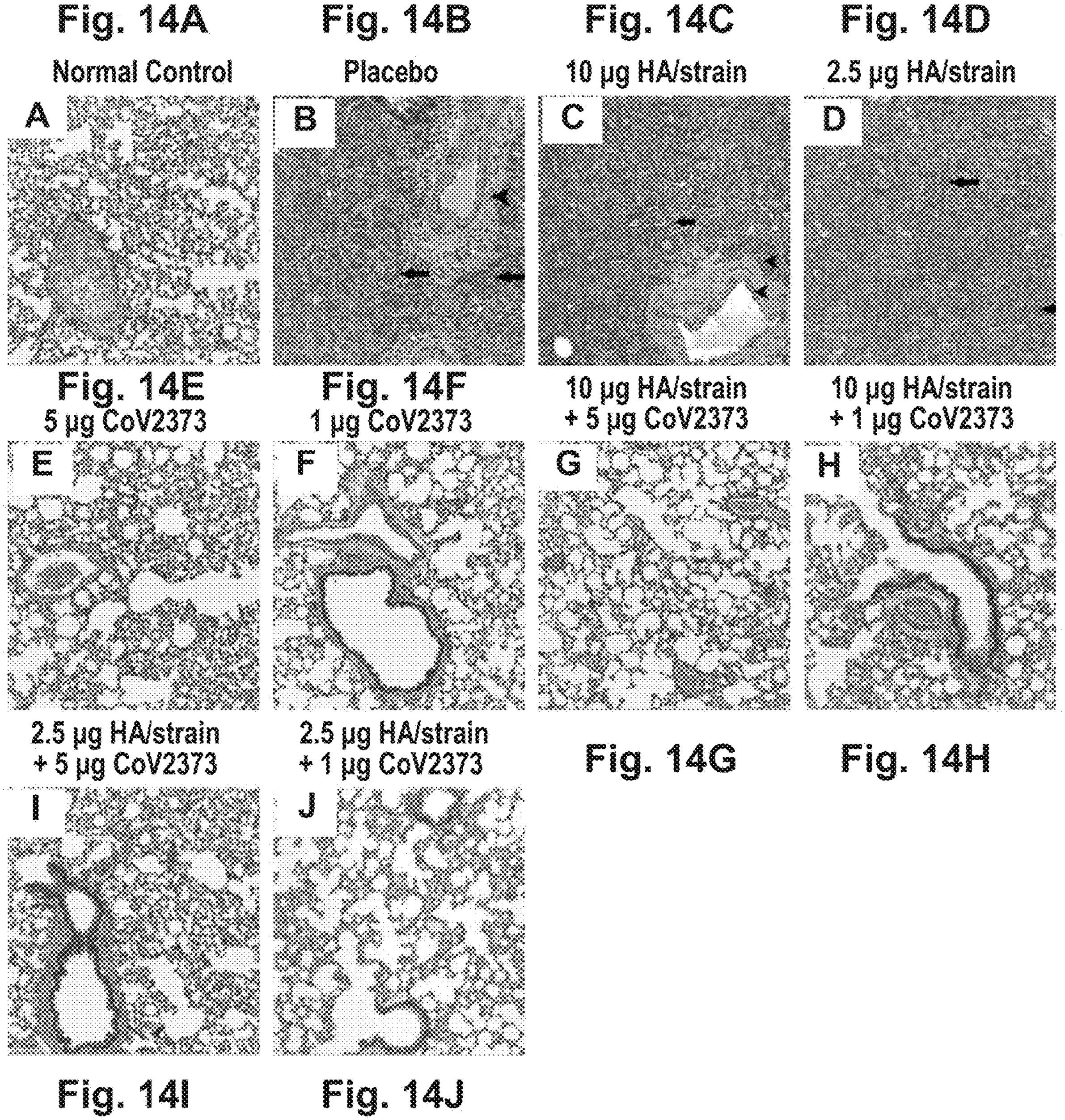
FIGS. 14A-14J show histopathologic changes in lungs of hamsters immunized with qNIV/CoV2373 combination vaccine and challenged with SARS-CoV-2. Groups of male and female hamsters were immunized with the combination qNIV/CoV2373 with 2.5 μg or 10 μg hemagglutinin (HA) per strain combined with 1 μg or 5 μg CoV2373 adjuvanted with saponin adjuvant. Comparator groups were immunize with 2.5 μg or 10 μg HA/strain or with 1 μg or 5 μg CoV2373 recombinant spike adjuvanted with 15 μg saponin adjuvant. All groups were immunized with 2 doses placed 14 days apart. The placebo group received formulation buffer. Three weeks following the second immunization (study day 35) all animals were challenged intranasally with 2.0×10'4 pfu SARS-CoV-2 and lungs collected 7 dpi. Histologic images were stained with hematoxylin and eosin (H&E).

Macroscopic and microscopic observations: All animals survived until the scheduled necropsy (study day 42). Lungs were collected and weighed. Lung weights were significantly higher ($p \leq 0.003$) in animals treated with placebo or immunized with qNIV compared to animals immunized with CoV2373 or qNIV/CoV2373 combination (FIG. 13G). Microscopic findings in the airways of placebo treated and qNIV immunized animals were the same and consisted of bronchiolo-alveolar hyperplasia, mixed alveolar inflammation, perivascular inflammation with edema in the surrounding tissues, and rare syncytial cells. There were no remarkable findings in the lungs of animals immunized with CoV2373 or qNIV/CoV2373 vaccines (FIGS. 14A-J). These results are consistent with high virus load and pneumonia in animals treated with placebo and receiving qNIV, while lungs of CoV2373 and qNIV/CoV2373 vaccinated animals were normal and free of virus.

An additional needed capability for a successful combination respiratory vaccine will be to provide coverage in the face of the inevitable viral evolution. The RNA respiratory viruses are especially prone to rapid evolution, often under immune pressure from the host and antigenic shift from zoonotic sources. Evolution of the SARS-CoV-2 virus under immune pressure in South Africa has led to apparent outbreaks in populations where some level of herd immunity had been established. In the context of seasonal influenza, viral evolution is a key challenge for effective immunization. Recently, multiple severe A(H3N2)-predominant influenza seasons occurred in the face of recurrent reports of poor field vaccine effectiveness. This appears driven by both antigenic mismatches arising from egg-based vaccines and the viruses themselves because of a rapid rate of antigenic evolution.

In this study, we demonstrate that a combination of qNIV/CoV2373 vaccine induced competitive polyclonal antibody responses against not only US-WA also the B.1.351 South Africa variant of SARS-CoV-2 spike protein RBD neutralizing epitopes. This study also demonstrated the potential for neutralizing epitopes that are in common between US-WA and B.1.352 RBD and induced by CoV2373 vaccine.

The remarkable events of 2019-20 saw both the appearance and surge of a novel coronavirus and COVID-19 disease concomitant with a near absence of seasonal influenza. At this time, it has been proposed that COVID-19 control measures may have led to the diminution of seasonal influenza cases while others have proposed ecological mechanisms. In either case, the past centuries indicated that influenza would recirculate, and cause disease and highly infectious and clinically important SARS-CoV-2 and emerging variants are likely to continue to evolve globally. Co-infection of influenza and SAR-CoV-2 have been described. Common clinical symptoms of COVID-19 include fever, chills, cough, and dyspnea, making it difficult to diagnose influenza virus infection. A retrospective study of hospitalized patients positive for SARS-CoV-2 with severe disease showed 12% (64 of 544 patients) were co-infected with influenza A (84%, 54 or 64) and influenza B (16%, 10 of 64). The clinical impact of influenza and SARS-CoV-2 co-infection, however, is unknown.

The future need for seasonal influenza and the ongoing need for SARS-CoV-2 vaccines makes the prospect of a combination vaccine highly desired due to the logistics of immunization with two vaccines annually. In this report, we describe a co-formulated influenza and SARS-CoV-2 nanoparticle vaccine to broadly protect against co-circulating seasonal influenza and COVID-19 viruses and with a potential due to broadly protective responses to address the challenge of emerging influenza strains and SARS-CoV-2 variants.

Materials and Methods: Virus stock and receptor: The SARS-CoV-2 (strain 2019-nCoV/USA-WA1/2020) isolate was obtained from the Center for Disease Control and stock virus prepared by passage in Vero E6 cells. A/Kansas/14/17, A/Brisbane/02/016, B/Maryland/15/16, and B/Phuket/3073/13 virus stocks were provided by Novavax, Inc. (Gaithersburg, MD, USA). Histidine-tagged human ACE2 receptor purchased from Sino Biologics (Beijing, CHN). Monoclonal antibody CR3022 [23] was obtained from Creative BioLabs (Shirley, NY, USA, cat #MRO-1214LC). SARS-CoV-2 US-WA recombinant 6-histidine tagged receptor binding domain (RBD) was provided by Novavax, Inc. (Gaithersburg, MD, USA). Histidine tagged B.1.351 spike RBD was obtained from Sino Biologics (cat #40592-V08H85, Beijing, CHN)

NVX-CoV2373 spike (S) protein and recombinant hemagglutinin vaccines. The CoV2373 vaccine was constructed from the full-length; wild-type SARS-CoV-2 S glycoprotein based upon the GenBank gene sequence MN908947 nucleotides 21563-25384. The native, full-length S protein was modified by mutating the putative furin cleavage site (682-RRAR-685 to 682-QQAQ-685) located within the S1/S2 cleavage domain to confer protease resistance. Two proline amino acid substitutions were inserted at positions K986P and V987P (2P) within the heptad repeat 1 (HR1) domain to stabilize SARS-CoV-2 S in a prefusion conformation.

The synthetic transgene was codon optimized and engineered into the baculovirus vector for expression in *Spodoptera frugiperda* (Sf9) insect cells (GenScript, Piscataway, NJ, USA). Spike trimers (designated CoV2373) were detergent extracted from the plasma membrane with Tris buffer containing TERGITOL NP-9 detergent and clarified by centrifugation. TMAE anion exchange and lentil lectin affinity chromatography was used to purify S-trimers. Purified CoV2373 was formulated in 25 mM sodium phosphate (pH 7.2), 300 mM NaCl, and 0.02% (v/v) polysorbate.

Cloning and expression of hemagglutinin (HA) nanoparticles: Influenza virus A/Kansas/14/17, A/Brisbane/02/016, B/Maryland/15/16, and B/Phuket/3073/13 HA genes were codon optimized for expression in Sf9 insect cells. Synthetic codon optimized HA genes were cloned into pBac1 baculovirus transfer vectors (Millipore Sigma, Billerica, MA, USA). pBacl plasmids were transfected into Sf9 with Flash-bacGOLD bacmid containing the *Autographa californica* polydedrosis virus genome (Oxford Expression Technology, Oxford UK). Sf9 cells cultures were infected with recombinant baculovirus expressing the HA genes. Recombinant HA was purified as previously described.

Ferret immunogenicity. Ferrets (n=30, 15 males and 15 females) were randomized into 5 groups. Animals were immunized by IM with 15 μg or 60 μg HA/strain with without or mixed with 5 μg CoV2373. A comparator group was immunized with 5 μg CoV2373. All vaccines were adjuvanted with 50 μg saponin adjuvant. All groups were immunized with a prime/boost regimen spaced 21 days apart. Sera were collected for analysis 21 days after the priming dose and 14 days after the booster immunization.

Hamster immunogenicity and SARS-CoV-2 challenge. Hamsters (n=54, 27 males and 27 females) 6-9 weeks old and weighing approximately 100 grams, were randomized into 10 groups (n=5-6/group). Animals were immunized by intramuscular (IM) injection with 10 μg HA/strain combined with 5 μg or 1 μg CoV2373; 2.5 μg HA/strain combined with 5 μg or 1 μg CoV2373; 10 μg HA/strain; 2.5 μg HA/strain; 5 μg CoV2373; or 1 μg CoV2373. Vaccines were mixed with 15 μg saponin adjuvant on the day of injection. All groups were immunized with a prime/boost regimen spaced 14 days apart. A placebo group (n=5) received formulation buffer on days 0 and 14. A sham control group (n=5) was not immunized. Fourteen days after the first immunization and 14 days after the booster immunization sera were collected for analysis.

SARS-CoV-2 intranasal challenge: Three weeks after the second immunization (study day 35) vaccinated and placebo animals were sedated with 80 mg/kg ketamine and 5 mg kg-1 xylazine in 20 μL sterile phosphate buffered saline (PBS), and inoculated by the intranasal route with $2.0\text{-}10^4$ pfu of SARS-CoV-2 (strain 2019-nCoV/USA-WA1/2020).

Anti-spike IgG ELISA: Spike protein ELISA was used to determine anti-SARS-CoV-2 spike (S) protein IgG titers in sera. Microtiter plates (Thermo Fisher Scientific, Rochester, NY, USA) were coated with 1.0 μg $mL^{-1}$ of SARS-CoV-2 S protein (CoV2373, Lot #16April20, Novavax, Inc. Gaithersburg, MD, USA). Plates washed with PBS-Tween (PBS-T) and non-specific binding was blocked with TBS Start-block blocking buffer (Thermo Fisher Scientific). Serum samples were serially diluted 3-fold starting with a 1:50 dilution and added to the coated plates, followed by incubation at room temperature for 2 hours. Following incubation, plates were washed with PBS-T and horseradish peroxidase (HRP)-conjugated goat anti-hamster IgG (Southern Biotech, Birmingham, AL, USA) added for 1 hour. Plates were washed with PBS-T and 3,3',5,5'-tetramethylbenzidine (TMB) peroxidase substrate (Sigma, St Louis, MO, USA) added. Reactions were stopped with TMB stop solution (ScyTek Laboratories, Inc. Logan, UT). Plates were read at OD 450 nm with a SpectraMax Plus plate reader (Molecular Devices, Sunnyvale, CA, USA). EC50 values were calculated by 4-parameter fitting using SoftMax Pro 6.5.1 GxP software. Individual animal anti-spike IgG titers were determined and the group geometric mean titers (GMTs), and 95% confidence intervals (f 95% CI) plotted using GraphPad Prism 8 software. A titer below the assay lower limit of detection (LOD) of 50 (starting dilution) was reported and a value of "25" assigned to the sample to calculate the group GMT.

Human ACE2 receptor blocking antibody ELISA: hACE2 receptor blocking antibody titers were determined by ELISA. Microtiter plates were coated with 1.0 μg $mL^{-1}$ SARS-CoV-2 S protein (CoV2373, Lot #02April20, Novavax, Inc., Gaithersburg, MD, USA) overnight at 4° C. Serum was serially diluted 2-fold starting with a 1:40 dilution and were added to coated wells and incubated for 1 hour at room temperature. After washing, 30 ng $mL^{-1}$ of histidine-tagged hACE2 (Sino Biologics, Beijing, CN) was added to wells for 1 hour at room temperature. HRP-conjugated anti-histidine IgG was added and incubated for 1 hour followed by addition of TMB substrate. Plates were read at OD 450 nm with a SpectraMax Plus plate reader (Molecular Devices, Sunnyvale, CA, USA) and data analyzed with SoftMax Pro 6.5.1 GxP software. The % inhibition for each dilution for each sample was calculated using the following equation in the SoftMax Pro program: 100-[(MeanResults/ControlValue@PositiveControl)*100].

Serum dilution versus % inhibition plot was generated, and curve fitting was performed by 4-parameter logistic (4PL) curve fitting to data. Serum antibody titer at 50% inhibition (IC50) of hACE2 to SARS-CoV-2 rS protein was determined in the SoftMax Pro program. Individual animal hACE2 receptor inhibiting titers, group GMT 95% CI were plotted using GraphPad Prism 8 software. For a titer below the assay lower limit of detection (LOD), a titer of <40 (starting dilution) was reported and a value of "20" assigned to the sample to calculate the group GMT.

Biolayer interferometry competitive binding assay: Competitive binding biolayer interferometry (BLI) assay was performed using an Octet QK 384 instrument (FortèBio). BLI studies were done with $his_6$-tagged SARS-CoV-2 rS protein receptor binding domain (RBD) coupled to Ni-NTA biosensor tips. The assay consisted of two steps: 1) experimental serum samples (1:200), pre-immune (day 0) negative control, and positive control samples prepared with pre-immune serum spiked with 5 μg $mL^{-1}$ of a spike-specific monoclonal antibody (mAb); and 2) competing SARS-CoV-2 mAb (5 μg $mL^{-1}$) was loaded onto the RBD biosensor tips and additional binding or competition measured. The competition of rS RBD protein binding of serum polyclonal antibody competing mAb was measured. Data were analyzed using Octet data analysis HT10.0 software. Data were normalized against placebo day 0 serum and percentage of binding and competition of rS RBD mAb. Competing antibody concentration (μg $mL^{-1}$) in serum samples were calculated based on percentage of polyclonal antibody competition and concentration of competing mAb.

Hemagglutinin inhibiting antibodies (HAI): HAI responses against influenza A/Brisbane/02/2018 (H1N1), A/Kansas/14/17 (H3N2), and B strains (B/Maryland/15/16 and B/Phuket/3073/13) were evaluated using Day 14 and Day 28 serum samples. A 0.75% suspension of human red blood cells (RBC, Biological Specialty Corporation, Allentown, PA, USA) was prepared in Dulbecco's phosphate-buffered saline (DPBS). Serum samples were treated with receptor-destroying enzyme (RDE) from *Vibrio cholerae* (Denka Seiken, Stamford, TX, USA) at 37° C. overnight to eliminate nonspecific red blood cell (RBC) hemagglutinating activity. RDE was inactivated the next day by incubation at 56° C. for 1 hour. RDE-treated sera were serially diluted 2-fold in DPBS (starting at 1:10, 25 μL) in 96-well, U bottom plates and incubated with standardized influenza virus concentration (4 HA Units in 25 μL) for 25 minutes. At the end of the incubation, 0.75% suspension of human RBC (50 μL) were added to each well and the plates were incubated at room temperature for 45 minutes. Hemagglutination inhibition (HAI) was determined by observing the O-ring shape formed by the RBCs in the sample wells and in the negative control wells. The HAI titers were recorded as the reciprocal of the highest serum dilution where HAI was observed (last well with O-ring). For a titer below the assay limit of detection (LOD), a titer of <10 (starting dilution) was reported and a value "5" assigned to the sample to calculate the group geometric mean titers (GMT).

Micro neutralization (MN) assay: Virus neutralizing antibodies against influenza A/Kansas/14/17 (H3N2), A/Brisbane/02/208 H1N, B/Phuket/3073/13, and B/Maryland/15/2016 were evaluated using Day 14 and Day 28 serum samples. Serum samples were heat-inactivated at 56° C. for 30 minutes, 2-fold serially diluted (starting at 1:20, 50 μL) and incubated with 100 TCID50 virus (50 μL) for 2 hours. At the end of incubation, 100 μL of $1.5\times10^5$ $mL^{-1}$ MDCK cells were added to each well and the plates were incubated with 5% C02 at 37° C. for influenza A virus or 32° C. for influenza B virus. After 18-22 hours incubation, cells were fixed with 80% cold acetone and incubated with murine monoclonal anti-influenza A or B nucleoprotein (Millipore Billerica, MA, USA) followed by peroxidase-conjugated goat anti-mouse IgG (Kirkegaard and Perry Laboratories, Gaithersburg, MD, USA). Optical density following development with 3-amino-9-ethylcarbazole (AEC) substrate (Sigma Aldrich, Saint Louis, MO, USA) was used to calculate the 50% micro neutralization titer (50% MN) for each serum sample. For a titer below the assay limit of detection (LOD), a titer of <20 (starting dilution) was reported and a value "10" assigned to the sample to calculate the group geometric mean titers (GMT).

Oral swabs, branchoalveolar lavage (BAL), and lung tissue sample collection: Oral swabs were collected on study days 37, 39, and 42 (2, 4 and 7 dpi). BAL samples and lungs were collected at necropsies carried out on 7 dpi. Lungs were weighed, divided in half; one set was weighed (~~0.1 to 0.2 grams) and snap frozen for virus titer determination. The second set was preserved in formalin for histopathology analysis. For viral load assays, tissues were weighed, placed into pre-labeled Sarstedt cryovials (2/sample), and snap-frozen on dry ice. Lung homogenates were prepared in 0.5 mL RNA-Stat for approximately 20 seconds using a handheld tissue homogenizer (Omni International, Kennesaw, GA, USA). The samples were clarified by centrifugation and supernatants isolated for viral load determination.

Quantification of subgenomic (sg) RNA by qRT-PCR: The qRT-PCR assay utilized primers and a probe designed to amplify and bind to a conserved region of nucleocapsid (N) gene of coronavirus. The signal was compared to a standard curve and calculated to give copies per mL. For the qRT-PCR assay, viral RNA was extracted from lung homogenates with RNA-STAT 60 (Tel-test"B") mixed with chloroform, precipitated and suspended in RNase-free 0.04% $NaN_3$ (AVE) buffer (Qiagen catalog #1020953). To generate a control for the amplification reaction, RNA was isolated from the virus stock using the same procedure. The amount of viral RNA was determined by comparing it to a known quantity of plasmid control. A final dilution of 108 copies per 3 μL was divided into single use aliquots of 10 μL stored at −80° C. The master mix was prepared with 2.5 mL of 2× buffer containing Taq-polymerase was prepared from the TaqMan RT-PCR kit (Bioline #BIO-78005). From the kit, 50

μL of the RT and 100 μL of RNAse inhibitor added. The primer pair at 2 μM concentration was added in a volume of 1.5 mL. 0.5 mL of water and 350 μL of the probe at a concentration of 2 μM are added and the tube vortexed. For the reactions, 45 μL of the master mix and 5 μL of the sample RNA are added to the wells of a 96-well plate in triplicate.

For control curve preparation, control viral RNA is prepared to contain $10^6$ to 107 copies per 3 μL. Ten-fold serial dilutions of control RNA was prepared using RNAse-free water by adding 5 μL of the control to 45 μL of water and repeating this for 7 dilutions. The standard curve range of 1 to $10^7$ copies/reaction. The sg-N used a known plasmid for its curve. Duplicate samples of each dilution are prepared as described above. For amplification, the plate was placed in an Applied Biosystems 7500 Sequence detector (ThermoFisher Scientific) and amplified using the following program: 48° C. for 30 minutes, 95° C. for 10 minutes followed by 40 cycles of 95° C. for 15 seconds, and 1 minute at 55° C. The number of copies of RNA per mL was calculated by extrapolation from the standard curve and multiplying by the reciprocal of 0.2 ml extraction volume. A range of 50 to $5\times10^8$ RNA copies per mL for nasal washes. Lung virus load was reported as RNA copies per gram homogenate. The sequences of the primers and probes used in this study are below;

```
2019-nCoV_N1-F:
                                  (SEQ ID NO: 169)
5'-GAC CCC AAA ATC AGC GAA AT-3'

2019-nCoV_N1-R:
                                  (SEQ ID NO: 170)
5'-TCT GGT TAG TGC CAG TTG AAT CTG-3'

2019-nCoV_N1-P:
                                  (SEQ ID NO: 171)
5'-6-FAM/ACCCCGCAT/ZEN/TACGTTTGGTGGACC/3IABkFQ

Sg-N-F
                                  (SEQ ID NO: 172)
5'-CGATCTCTTGTAGATCTGTTCTC-3'

Sg-N-R
                                  (SEQ ID NO: 173)
5'-GGTGAACCAAGACGCAGTAT-3'

Sg-N-P
                                  (SEQ ID NO: 174)
5'-6-FAM/TAACCAGAA/ZEN/TGGAGAACGCAGTGGG/3IABkFQ
```

Histopathology: Lung samples collected at necropsy 7 days post-challenge were placed in 10% neutral formalin. Fixed tissues were processed and stained with hematoxylin and eosin (H&E) for histological examination. A board-certified pathologist (Experimental Pathology Laboratories, Inc. (EPI, Sterling, VA, USA) examined H&E slides in a blinded fashion.

Statistical analysis: GraphPad Prism 9.0.0 software was used for statistical analysis. Serum antibody titers were graphically displayed for individual animals and the geometric mean titer (GMT) and 95% confidence interval (95% CI) intervals plotted. Virus loads were plotted as the median value, interquartile range, and the minimum and maximum values. Student's t-test was used to determine differences between paired groups as indicated the figure legends. $p\leq0.05$ was considered significant.

Example 5

Phase 1/2 Study Evaluating the Safety and Efficacy of an Immunogenic Composition Against COVID-19 and Influenza The immunogenicity and efficacy of a combination immunogenic composition against COVID-19 and influenza, also referred to as "qNIV/CoV2373" or "ICC vaccine" was evaluated in a Phase 1/2 trial containing about 640 healthy participants, aged 50-70 years. The median age of the participants was 59 years old. The trial population contained 62% males and 38% females. 100 percent of participants had previously received a primary COVID-19 vaccination series with an mRNA encoding a CoV S polypeptide or an adenovirus vaccine comprising DNA encoding a CoV S polypeptide.

The combination immunogenic composition comprises (i) nanoparticles containing hemagglutinin (HA) from four different influenza strain; (ii) nanoparticles containing a CoV S polypeptide of SEQ ID NO: 87; and (iii) a saponin adjuvant (i.e., 85% Fraction A ISCOM matrix and 15% Fraction C ISCOM matrix). 14 different combination doses of CoV S polypeptide and HA were evaluated (Table 4). Table 4 shows the study design of the trial and the amount of hemagglutinin, CoV S polypeptide, and saponin adjuvant in each group. Patients were administered an initial dose of the immunogenic composition at day 0 and a boost dose of the immunogenic composition 56 (+5 days) after administration of the initial dose.

The combination immunogenic composition's immunogenicity and efficacy against COVID-19 and influenza was compared to an immunogenic composition containing hemagglutinin nanoparticles and saponin adjuvant (Hemagglutinin Immunogenic Composition) and an immunogenic composition containing CoV S polypeptide and saponin adjuvant (CoV S polypeptide Immunogenic Composition).

TABLE 4

| Study Design | | | | | | | |
|---|---|---|---|---|---|---|---|
| | | Day 0 | | | Day 56 (+5 days) | | |
| Vaccine Group | N | Amount of Hemagglutinin per strain (μg) | Amount of CoV S polypeptide (μg) | Saponin adjuvant (μg) | Amount of Hemagglutinin per strain (μg) | Amount of CoV S polypeptide (μg) | Saponin adjuvant (μg) |
| ICC vaccine formulations | | | | | | | |
| A | 40 | 60 | 22.5 | 50 | 60 | 22.5 | 50 |
| B | 40 | 10 | 2.5 | 50 | 10 | 2.5 | 50 |
| C | 40 | 60 | 22.5 | 50 | 60 | 22.5 | 50 |
| D | 40 | 10 | 7.5 | 50 | 10 | 7.5 | 50 |
| E | 40 | 10 | 22.5 | 50 | 10 | 22.5 | 50 |
| F | 40 | 35 | 7.5 | 50 | 35 | 7.5 | 50 |
| G | 40 | 5 | 22.5 | 50 | 5 | 22.5 | 50 |

TABLE 4-continued

| Study Design | | | | | | | | |
|---|---|---|---|---|---|---|---|---|
| | | Day 0 | | | Day 56 (+5 days) | | | |
| Vaccine Group | N | Amount of Hemagglutinin per strain (μg) | Amount of CoV S polypeptide (μg) | Saponin adjuvant (μg) | Amount of Hemagglutinin per strain (μg) | Amount of CoV S polypeptide (μg) | Saponin adjuvant (μg) |
| H | 40 | 60 | 2.5 | 50 | 60 | 2.5 | 50 |
| I | 40 | 5 | 7.5 | 50 | 5 | 7.5 | 50 |
| J | 40 | 5 | 2.5 | 50 | 5 | 2.5 | 50 |
| K | 40 | 35 | 22.5 | 50 | 35 | 22.5 | 50 |
| L | 40 | 35 | 2.5 | 50 | 35 | 2.5 | 50 |
| M | 40 | 60 | 7.5 | 50 | 60 | 7.5 | 50 |
| N | 40 | 60 | 2.5 | 50 | 60 | 2.5 | 50 |
| Hemagglutinin Immunogenic Composition | | | | | | | |
| O[1] | 40 | 60 | 0 | 75 | 0 | 5 | 50 |
| CoV S polypeptide Immunogenic Composition | | | | | | | |
| P | 40 | 0 | 5 | 50 | 0 | 5 | 50 |
| Total | 640 | | | | | | |

The combination vaccines were well tolerated. The most common solicited local adverse event was pain and tenderness at the injection site. The most common systemic adverse event was fatigue, headache, malaise, muscle pain, or fever. Most adverse events were Grade 0, Grade 1, or Grade 2 adverse events. There were rare grade 3 events and no grade 4 events. Adverse events did not vary substantially by dose of CoV S polypeptide. However, adverse events increased slightly with increasing dose of hemagglutinin. There were no adverse events of special interest.

The serum of patients was collected at days 0, 28, 56, and 70 to quantify the titer of anti-Spike IgG antibodies and hemagglutinin inhibition antibody (HAI) geometric mean titers against various influenza strains.

Figure 15:
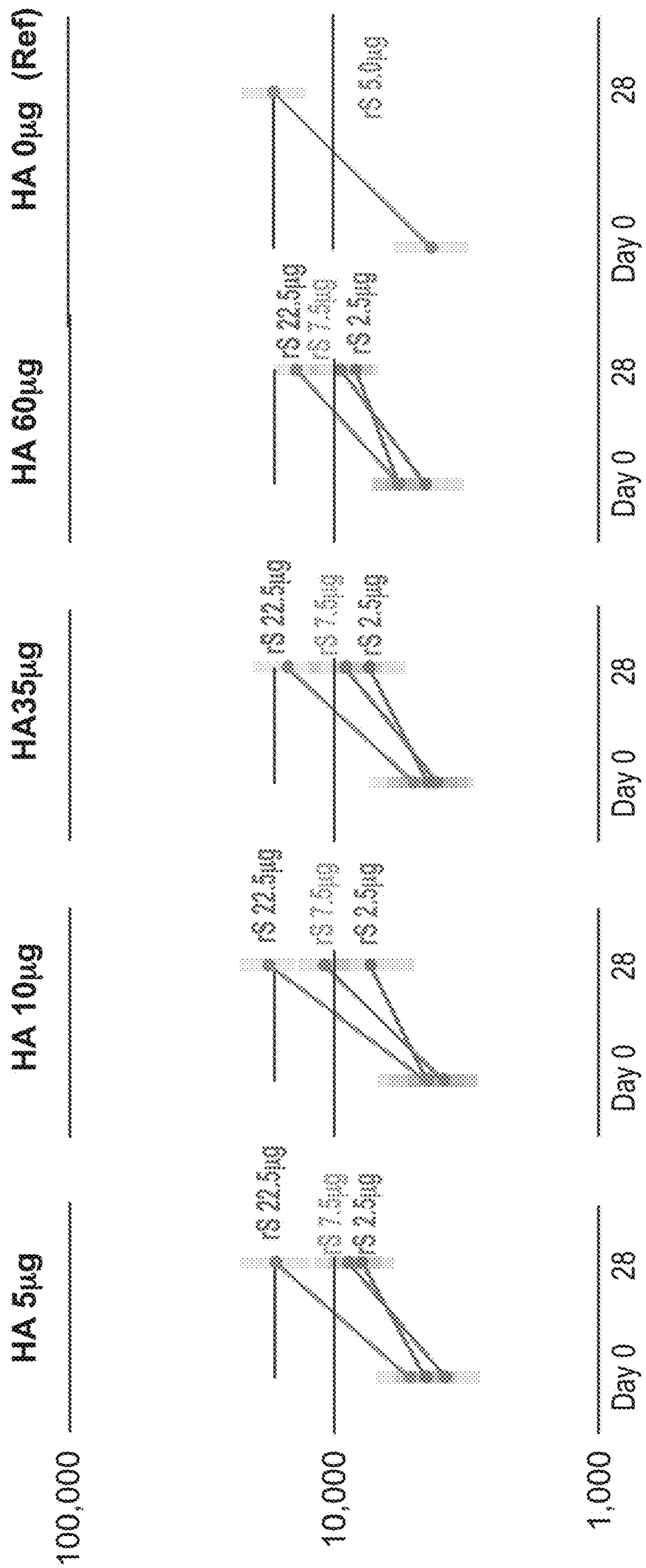
FIG. 15 shows the titer of anti-Spike IgG antibodies as a function of dose of hemagglutinin and CoV S polypeptide from day 0 to day 28 after immunization according to Example 5.
Figure 16:
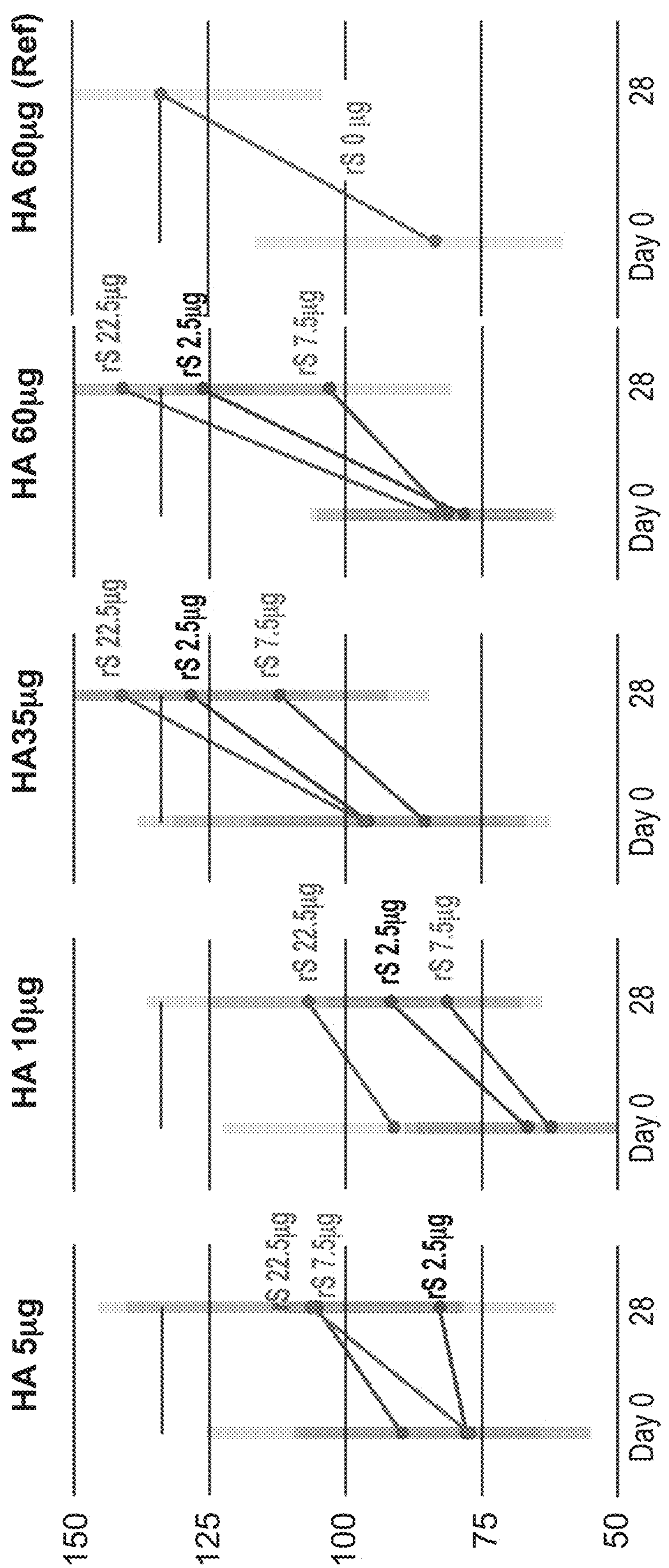
FIG. 16 shows the HAI geometric mean titers against A/Brisbane H1N1 as a function of dose of hemagglutinin and CoV S polypeptide from day 0 to day 28 after immunization according to Example 5.
Figure 17:
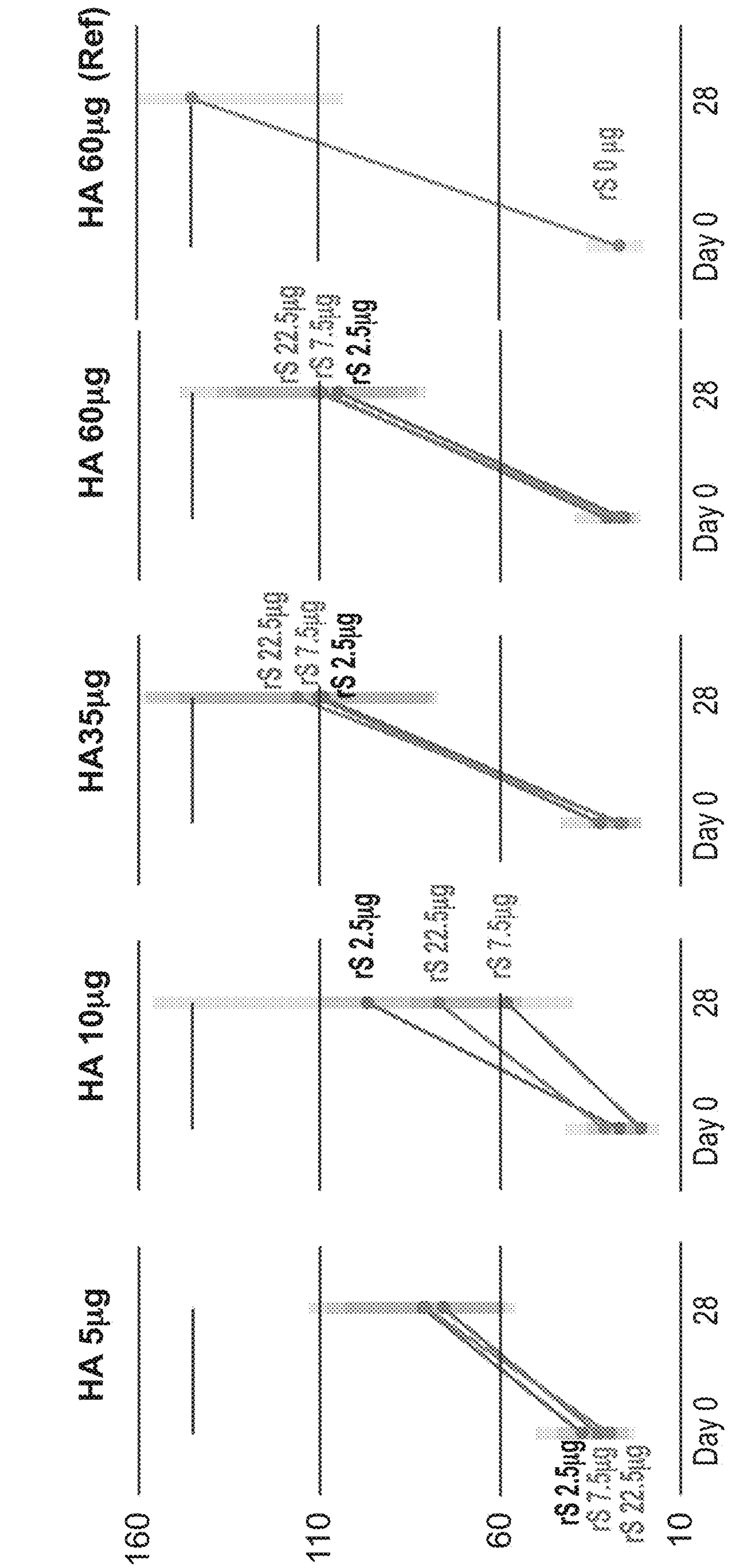
FIG. 17 shows the HAI geometric mean titers against A/Kansas H3N2 as a function of dose of hemagglutinin and CoV S polypeptide from day 0 to day 28 after immunization according to Example 5.
Figure 18:
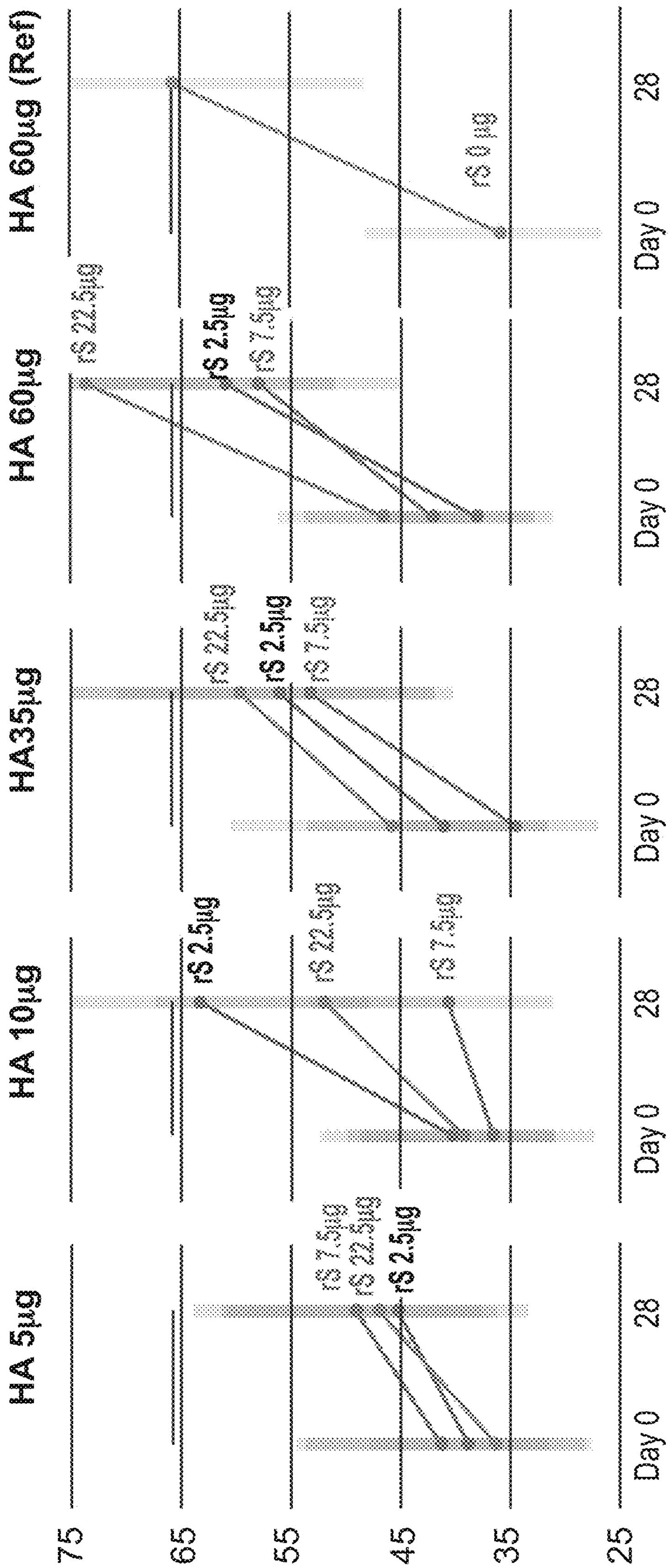
FIG. 18 shows the HAI geometric mean titers against B/Maryland (Vic) as a function of dose of hemagglutinin and CoV S polypeptide from day 0 to day 28 after immunization according to Example 5.
Figure 19:
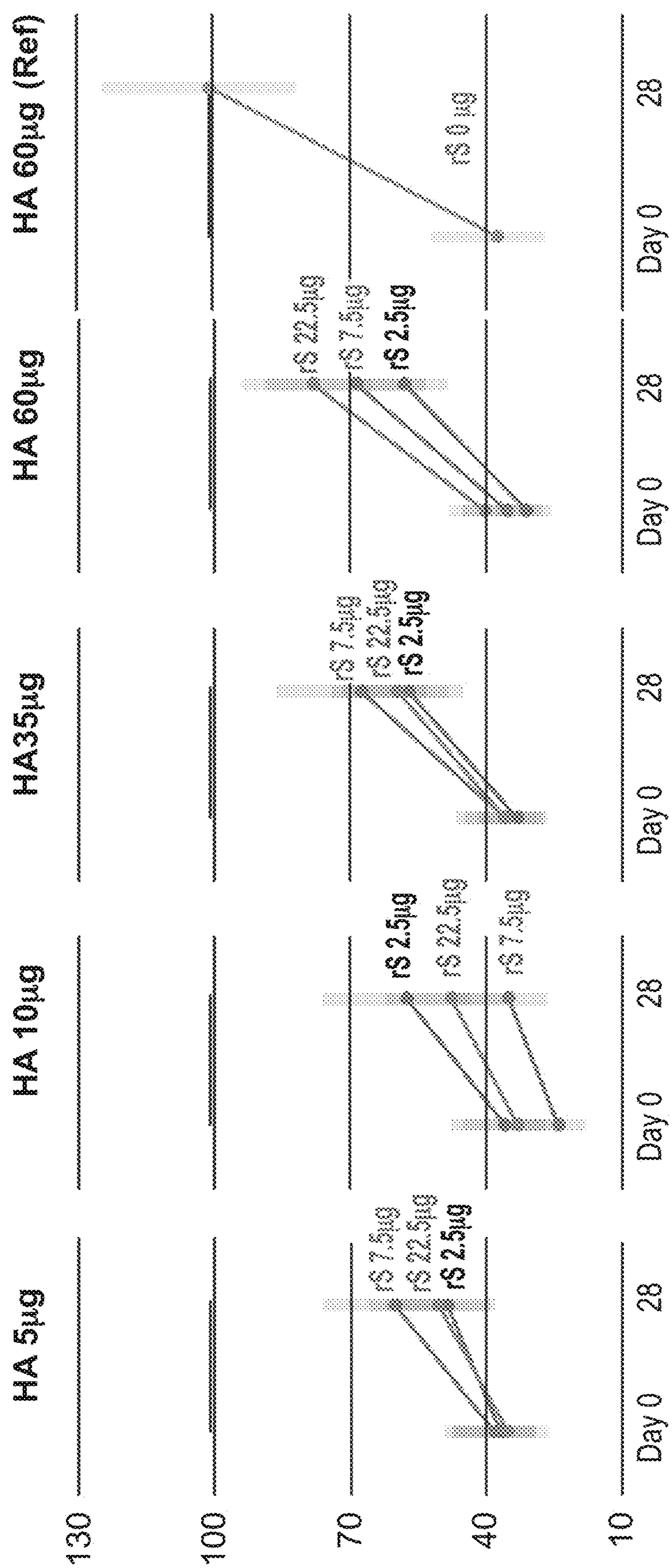
FIG. 19 shows the HAI geometric mean titers against B/Phuket (Yam) as a function of dose of hemagglutinin and CoV S polypeptide from day 0 to day 28 after immunization according to Example 5.

FIG. 15 shows the titer of anti-Spike IgG antibodies as a function of dose of hemagglutinin and CoV S polypeptide from day 0 to day 28 after immunization. FIG. 16 shows the HAI geometric mean titers against A/Brisbane H1N1 as a function of dose of hemagglutinin and CoV S polypeptide from day 0 to day 28 after immunization. FIG. 17 shows the HAI geometric mean titers against A/Kansas H3N2 as a function of dose of hemagglutinin and CoV S polypeptide from day 0 to day 28 after immunization. FIG. 18 shows the HAI geometric mean titers against B/Maryland (Vic) as a function of dose of hemagglutinin and CoV S polypeptide from day 0 to day 28 after immunization. FIG. 19 shows the HAI geometric mean titers against B/Phuket (Yam) as a function of dose of hemagglutinin and CoV S polypeptide from day 0 to day 28 after immunization.

This data shows that compositions containing a combination of hemagglutinin and CoV S polypeptide induce comparable or more anti-Spike IgG antibodies than a composition containing CoV S polypeptide alone. (FIG. 15). Additionally, the compositions are effective against four strains of influenza virus.

NUMBERED EMBODIMENTS OF THE DISCLOSURE

1. An immunogenic composition comprising:
   (a) a coronavirus S (CoV S) glycoprotein in the form of a detergent-core nanoparticle, wherein the detergent is a non-ionic detergent;
   (b) at least three hemagglutinin (HA) glycoproteins, wherein each HA glycoprotein is from a different influenza strain; and
   (c) a pharmaceutically acceptable buffer.
2. The immunogenic composition of embodiment 1, wherein the at least three HA glycoproteins are in a form selected from the group consisting of:
   (a) detergent-core nanoparticles comprising hemagglutinin (HA);
   (b) HaSMaNs (Hemagglutinin Saponin Matrix Nanoparticles);
   (c) an inactivated whole influenza virus;
   (d) a hemagglutinin composition extracted from an influenza virus; optionally an influenza split-virion composition or a subunit influenza composition;
   and any combination thereof.
3. The immunogenic composition of any one of embodiments 1-2, wherein at least one HA glycoprotein is in the form of a detergent-core nanoparticle comprising HA and at least one HA glycoprotein is in the form of a HaSMaN.
4. The immunogenic composition of any one of embodiments 1-3, wherein the at least three HA glycoproteins are derived from a cell-culture based process or egg-based manufacturing process.
5. The immunogenic composition of any one of embodiments 2-4, wherein the hemagglutinin glycoprotein of the detergent-core nanoparticle is from a Type B influenza strain.
6. The immunogenic composition of any one of embodiments 2-5, wherein the hemagglutinin glycoprotein of the detergent-core nanoparticle is from a Type A influenza strain.
7. The immunogenic composition of any one of embodiments 2-6, wherein the detergent-core nanoparticle is a trypsin-resistant nanoparticle.
8. The immunogenic composition of any one of embodiments 2-7, wherein the HaSMaN is a trypsin-resistant nanoparticle.
9. The immunogenic composition of any one of embodiments 1-9, wherein the detergent is PS80.
10. The immunogenic composition of any one of embodiments 1-9, wherein the influenza strain is of a subtype selected from the group consisting of H1, H2, H3, H4, H5, H6, H7, H8, H9, H10, H11, H12, H13, H14, H15, H16, H17, and H18.

11. The immunogenic composition of any one of embodiments 2-10, wherein the pharmaceutically acceptable buffer comprises (i) sodium phosphate at about 25 mM; (ii) sodium chloride at about 150 mM; (iii) arginine hydrochloride at about 100 mM; (iv) trehalose at about 5%; wherein the composition pH is at about 7.5.

12. The immunogenic composition of any one of embodiments 2-11, comprising an additional one or more detergent-core nanoparticles and an additional one or more HaSMaNs, wherein each detergent-core nanoparticle comprises a Type B strain HA glycoprotein and each HaSMaN comprises a Type A strain HA glycoprotein, wherein each HA glycoprotein is from a different influenza strain.

13. The immunogenic composition of any one of embodiments 1-12, wherein the CoV S glycoprotein comprises:

(i) an S1 subunit with an inactivated furin cleavage site, wherein the S1 subunit comprises an N-terminal domain (NTD), a receptor binding domain (RBD), subdomains 1 and 2 (SD1/2), wherein the inactivated furin cleavage site has an amino acid sequence of QQAQ (SEQ ID NO: 7);

wherein the NTD optionally comprises one or more modifications selected from the group consisting of:

(a) deletion of one or more amino acids selected from the group consisting of amino acid 56, 57, 131, 132, 144, 145, 228, 229, 230, 231, 234, 235, 236, 237, 238, 239, 240 and combinations thereof;

(b) insertion of 1, 2, 3, or 4 amino acids after amino acid 132; and (c) mutation of one or more amino acids selected from the group consisting of amino acid 5, 6, 7, 13, 51, 53, 56, 57, 62, 63, 67, 82, 125, 129, 131, 132, 133, 139, 143, 144, 145, 177, 200, 201, 202, 209, 229, 233, 240, 245, and combinations thereof;

wherein the RBD optionally comprises mutation of one or more amino acids selected from the group consisting of amino acid 333, 404, 419, 426, 439, 440, 464, 465, 471, 477, 481, 488, and combinations thereof;

wherein the SD1/2 domain optionally comprises mutation of one or more amino acids selected from the group consisting of 557, 600, 601, 642, 664, 668, and combinations thereof; and (ii) an S2 subunit, wherein amino acids 973 and 974 are proline, wherein the S2 subunit optionally comprises one or more modifications selected from the group consisting of:

(a) deletion of one or more amino acids from 676-685, 676-702, 702-711, 775-793, 806-815 and combinations thereof;

(b) mutation of one or more amino acids selected from the group consisting of 688, 703, 846, 875, 937, 969, 1014, 1058, 1105, and 1163 and combinations thereof; and (c) deletion of one or more amino acids from the TMCT;

wherein the amino acids of the CoV S glycoprotein are numbered with respect to a polypeptide having the sequence of SEQ ID NO: 2.

14. The immunogenic composition of embodiment 14, wherein the CoV S polypeptide comprises or consists of an amino acid sequence having at least 90%, at least 91%, at least 92%, at least 93%, at least 94%, at least 95%, at least 96%, at least 97%, at least 98%, at least 99%, or 100% identity to any one of SEQ ID NOS: 86-89, 105, 106, 112-115, and 164-168.

15. The immunogenic composition of embodiment 14, wherein each of the S2 subunit, NTD, RBD, and SD1/2 is at least 95% identical to the corresponding subunit or domain of the CoV S glycoprotein having an amino acid sequence of SEQ ID NO: 2.

16. The immunogenic composition of embodiment 14, wherein each of the S2 subunit, NTD, RBD, and SD1/2 is at least 97% identical to the corresponding subunit or domain of the CoV S glycoprotein having an amino acid sequence of SEQ ID NO: 2.

17. The immunogenic composition of embodiment 14, wherein each of the S2 subunit, NTD, RBD, and SD1/2 is at least 99% identical to the corresponding subunit or domain of the CoV S glycoprotein having an amino acid sequence of SEQ ID NO: 2.

18. The immunogenic composition of embodiment 14, wherein each of the S2 subunit, NTD, RBD, and SD1/2 is at least 99.5% identical to the corresponding subunit or domain of the CoV S glycoprotein having an amino acid sequence of SEQ ID NO: 2.

19. The immunogenic composition of any one of embodiments 1-18, comprising three or four hemagglutinin glycoproteins.

20. The immunogenic composition of any one of embodiments 1-19, comprising up to 4, up to 5, up to 6, up to 7, up to 8, up to 9, or up to 10 HA glycoproteins.

21. The immunogenic composition of any one of embodiments 1-20, wherein each HA glycoprotein is in the form of a nanoparticle.

22. The immunogenic composition of embodiment 21, wherein each nanoparticle comprises a HA glycoprotein from a single influenza strain.

23. The immunogenic composition of embodiment 22, wherein each nanoparticle is a detergent-core nanoparticle or a HaSMaN.

24. The immunogenic composition of embodiment 14, wherein the S2 subunit is at least 90%, at least 91%, at least 92%, at least 93%, at least 94%, at least 95%, at least 96%, at least 97%, at least 98%, at least 99%, or 100% identical to the corresponding subunit of the CoV S glycoprotein having an amino acid sequence of SEQ ID NO: 2.

25. The immunogenic composition of embodiment 14, wherein the NTD is at least 90%, at least 91%, at least 92%, at least 93%, at least 94%, at least 95%, at least 96%, at least 97%, at least 98%, at least 99%, or 100% identical to the corresponding subunit of the CoV S glycoprotein having an amino acid sequence of SEQ ID NO: 2.

26. The immunogenic composition of embodiment 14, wherein the RBD is at least 90%, at least 91%, at least 92%, at least 93%, at least 94%, at least 95%, at least 96%, at least 97%, at least 98%, at least 99%, or 100% identical to the corresponding subunit of the CoV S glycoprotein having an amino acid sequence of SEQ ID NO: 2.

27. The immunogenic composition of embodiment 14, wherein the SD1/2 is at least 90%, at least 91%, at least 92%, at least 93%, at least 94%, at least 95%, at least 96%, at least 97%, at least 98%, at least 99%, or 100% identical to the corresponding subunit of the CoV S glycoprotein having an amino acid sequence of SEQ ID NO: 2.

28. The immunogenic composition of any one of embodiments 1-27, comprising an adjuvant.

29. The immunogenic composition of embodiment 28, wherein the adjuvant comprises at least two iscom particles, wherein:

the first iscom particle comprises fraction A of *Quillaja Saponaria Molina* and not fraction C of *Quillaja Saponaria Molina*; and the second iscom particle comprises fraction C of *Quillaja Saponaria Molina* and not fraction A of *Quillaja Saponaria Molina*.

30. The immunogenic composition of embodiment 29, wherein fraction A of *Quillaja Saponaria Molina* and fraction C of *Quillaja Saponaria Molina* account for about 92% by weight and about 8% by weight, respectively, of the sum of weights of fraction A of *Quillaja Saponaria Molina* and fraction C of *Quillaja Saponaria Molina* in the adjuvant.

31. The immunogenic composition of embodiment 29, wherein fraction A of *Quillaja Saponaria Molina* and fraction C of *Quillaja Saponaria Molina* account for about 85% by weight and about 15% by weight, respectively, of the sum of weights of fraction A of *Quillaja Saponaria Molina* and fraction C of *Quillaja Saponaria Molina* in the adjuvant.

32. The immunogenic composition of embodiment 28, wherein the adjuvant is administered at a dose of about 50 μg or about 75 μg.

33. A method of stimulating an immune response against SARS-CoV-2, a heterogeneous SARS-CoV-2 strain, an influenza virus, or a combination thereof in a subject comprising administering the immunogenic composition of any one of embodiments 1-32.

34. The method of embodiment 33, wherein the subject is administered a first dose at day 0 and a boost dose at day 56.

35. The method of embodiment 33, wherein the subject is administered from about 1 μg to about 25 μg of CoV S glycoprotein.

36. The method of embodiment 33, wherein the subject is administered about 3 μg, about 5 μg, about 25 μg, about 22.5 μg, about 7.5 μg, or about 2.5 μg of coronavirus S glycoprotein.

37. The method of embodiment 33, wherein the subject is administered about 5 μg, about 10 μg, about 24 μg, about 25 μg, about 26 μg, about 27 μg, about 28 μg, about 29 μg, about 30 jig, about 31 μg, about 32 μg, about 33 μg, about 34 μg, about 35 μg, about 36 μg, about 37 μg, about 38 μg, about 39 μg, about 40 μg, or about 60 μg of hemagglutinin per strain.

38. The method of any one of embodiments 33-37, comprising administering the subject from about 20 μg to about 50 μg of CoV S glycoprotein and from about 24 μg to about 40 μg of hemagglutinin per strain.

39. The method of any one of embodiments 33-37, comprising administering the subject from about 1 μg to about 50 μg of CoV S glycoprotein and from about 5 μg to about 60 μg of hemagglutinin per strain.

40. The method of any one of embodiments 33-37, comprising administering the subject about 3 μg, about 5 μg, about 25 μg, about 22.5 μg, about 7.5 μg, or about 2.5 μg of coronavirus S glycoprotein.

41. The method of any one of embodiments 33-37, comprising administering the subject about 5 μg, about 10 μg, about 24 μg, about 25 μg, about 26 μg, about 27 μg, about 28 μg, about 29 μg, about 30 μg, about 31 μg, about 32 μg, about 33 μg, about 34 μg, about 35 μg, about 36 μg, about 37 μg, about 38 μg, about 39 μg, about 40 μg, or about 60 μg of hemagglutinin per strain.

42. The method of embodiment 33, comprising administering the immunogenic composition intramuscularly.

43. The method of any one of embodiments 33 and 35-42 wherein a single dose of the immunogenic composition is administered.

44. The method of any one of embodiments 33-43, wherein the heterogenous SARS-CoV-2 strain is selected from the group consisting of Ca1.20C SARS-CoV-2 strain, P.1 SARS-CoV-2 strain, B.1.351 SARS-CoV-2 strain, B.1.1.7 SARS-CoV-2 strain, SARS-CoV-2 B.1.617.2 strain, B.1.525 strain, B. 1.526 strain, B.1.617.1 strain, C.37 strain, B.1.621 strain, or the SARS-CoV-2 omicron strain.

45. The method of any one of embodiments 33-43, wherein the efficacy of the immunogenic composition for preventing coronavirus disease-19 (COVID-19) is is at least 50%, at least about 55%, at least about 60%, at least about 65%, at least about 70%, at least about 75%, at least about 80%, at least about 85%, about least about 90%, at least about 91%, at least about 92%, at least about 93%, at least about 94%, at least about 95%, at least about 96%, at least about 97%, at least about 98%, or at least about 99%, or about 100% for up to about 2 months, up to about 2.5 months, up to about 3 months, up to about 3.5 months, up to about 4 months, up to about 4.5 months, up to about 5 months, up to about 5.5 months, up to about 6 months, up to about 6.5 months, up to about 7 months, up to about 7.5 months, up to about 8 months, up to about 8.5 months, up to about 9 months, up to about 9.5 months, up to about 10 months, up to about 10.5 months, up to about 11 months, up to about 11.5 months, or up to about 12 months after administration of the immunogenic composition.

46. The method of any one of embodiments 33-43, wherein the efficacy of the immunogenic composition for preventing coronavirus disease-19 (COVID-19) is from about 50% to about 99%, from about 50% to about 95%, from about 50% to about 90%, from about 50% to about 85%, from about 50% to about 80%, from about 60% to about 99%, from about 60% to about 95%, from about 60% to about 90%, from about 60% to about 85%, from about 60% to about 80%, from about 40% to about 99%, from about 40% to about 95%, from about 40% to about 90%, from about 40% to about 85%, from about 40% to about 80%, from about 40% to about 75%, from about 40% to about 70%, from about 40% to about 65%, from about 40% to about 55%, or from about 40% to about 50% for up to about 2 months, up to about 2.5 months, up to about 3 months, up to about 3.5 months, up to about 4 months, up to about 4.5 months, up to about 5 months, up to about 5.5 months, up to about 6 months, up to about 6.5 months, up to about 7 months, up to about 7.5 months, up to about 8 months, up to about 8.5 months, up to about 9 months, up to about 9.5 months, up to about 10 months, up to about 10.5 months, up to about 11 months, up to about 11.5 months, or up to about 12 months after administration of the immunogenic composition.

47. A method for stimulating an immune response against SARS-CoV-2, a heterogeneous SARS-CoV-2 strain, an influenza virus, or a combination thereof in a subject comprising:

(a) administering a first immunogenic composition comprising (i) a CoV S glycoprotein the form of a detergent-core nanoparticle, wherein the detergent is a non-ionic detergent and (ii) a pharmaceutically acceptable buffer; and (b) administering a second immunogenic composition comprising (i) at least three HA glycoproteins, wherein each HA glycoprotein is from a different influenza strain and (ii) a pharmaceutically acceptable buffer.

48. The method of embodiment 47, wherein the dose of the first immunogenic composition comprises from about 1 μg to about 50 μg of CoV S glycoprotein.
49. The method of any one of embodiments 47-48, wherein the dose of the second immunogenic composition comprises between about 5 μg and about 100 μg of hemagglutinin.
50. The method of any one of embodiments 47-49, wherein the first immunogenic composition and second immunogenic composition are administered intramuscularly.
51. The method of any one of embodiments 47-49, wherein the first immunogenic composition is administered intramuscularly and the second immunogenic composition is administered intranasally.
52. The method of any one of embodiments 47-451, wherein the first immunogenic composition and second immunogenic composition are administered within 15 minutes of one another.
53. The method of any one of embodiments 47-50 and 52, wherein the first immunogenic composition and second immunogenic composition are administered in the same arm.
54. The method of any one of embodiments 47-50 and 52, wherein the first immunogenic composition and second immunogenic composition are administered in different arms.
55. The method of any one of embodiments 47-54, wherein the second immunogenic composition comprises at least three HA glycoproteins, wherein each glycoprotein is independently in a form selected from the group consisting of:
- (a) detergent-core nanoparticles comprising hemagglutinin (HA);
- (b) HaSMaNs (Hemagglutinin Saponin Matrix Nanoparticles);
- (c) an inactivated whole influenza virus;
- (d) a hemagglutinin composition extracted from an influenza virus; optionally an influenza split-virion composition or a subunit influenza composition;

and any combination thereof.
56. The method of embodiment 55, wherein at least one HA glycoprotein is in the form of a detergent-core nanoparticle comprising HA and at least one HA glycoprotein is in the form of a HaSMaN.
57. The method of any one of embodiments 47-56, wherein the second immunogenic composition comprises at least three HA glycoproteins in a form of a hemagglutinin composition extracted from a virus.
58. The method of embodiment 57, wherein the hemagglutinin composition extracted from a virus is an influenza split-virion.
59. The method of embodiment 55, wherein the second immunogenic composition comprises at least one HA glycoprotein in the form of a detergent-core nanoparticle comprising hemagglutinin and at least one hemagglutinin in the form of a HaSMaN.
60. The method of any one of embodiments 47-59, wherein the second immunogenic composition comprises at least four HA glycoproteins, wherein each HA glycoprotein is from a different influenza strain.
61. A pre-filled syringe comprising the immunogenic composition of any one of embodiments 1-32.

INCORPORATION BY REFERENCE

All references, articles, publications, patents, patent publications, and patent applications cited herein are incorporated by reference in their entireties for all purposes. However, mention of any reference, article, publication, patent, patent publication, and patent application cited herein is not, and should not be taken as, an acknowledgment or any form of suggestion that they constitute valid prior art or form part of the common general knowledge in any country in the world. This application additionally incorporates the contents of the following patent documents in their entirety: U.S. Pat. No. 10,426,829, U.S. Publication No. 2019/0314487, U.S. Pat. Nos. 10,953,089; 10,729,764, and 8,821,881.

SEQUENCE LISTING (174 sequences)

SEQ ID NO: 1 - protein, 1273 aa, Betacoronavirus severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - protein, 1260 aa, Betacoronavirus severe acute respiratory syndrome coronavirus 2
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 3 - protein, 1273 aa, Artificial Sequence
  RECOMBINANT S PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 4 - protein, 1260 aa, Artificial Sequence
  RECOMBINANT S PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 5 - protein, 13 aa, Artificial Sequence
  SIGNAL PEPTIDE
MFVFLVLLPLVSS

SEQ ID NO: 6 - protein, 4 aa, Artificial Sequence
  RECOMBINANT FURIN CLEAVAGE SITE
RRAR

SEQ ID NO: 7 - protein, 4 aa, Artificial Sequence
  RECOMBINANT FURIN CLEAVAGE SITE
QQAQ

SEQ ID NO: 8 - protein, 4 aa, Artificial Sequence
  RECOMBINANT FURIN CLEAVAGE SITE
QRAR

SEQ ID NO: 9 - protein, 4 aa, Artificial Sequence
  RECOMBINANT FURIN CLEAVAGE SITE
RQAR

SEQ ID NO: 10 - protein, 4 aa, Artificial Sequence
  RECOMBINANT FURIN CLEAVAGE SITE
RRAQ

SEQ ID NO: 11 - protein, 4 aa, Artificial Sequence
  RECOMBINANT FURIN CLEAVAGE SITE
QQAR

SEQ ID NO: 12 - protein, 4 aa, Artificial Sequence
  RECOMBINANT FURIN CLEAVAGE SITE
RQAQ

SEQ ID NO: 13 - protein, 4 aa, Artificial Sequence
  RECOMBINANT FURIN CLEAVAGE SITE
QRAQ

SEQ ID NO: 14 - protein, 4 aa, Artificial Sequence
  RECOMBINANT FURIN CLEAVAGE SITE
NNAN

SEQ ID NO: 15 - protein, 4 aa, Artificial Sequence
  RECOMBINANT FURIN CLEAVAGE SITE
NRAR

SEQ ID NO: 16 - protein, 4 aa, Artificial Sequence
  RECOMBINANT FURIN CLEAVAGE SITE
RNAR

SEQ ID NO: 17 - protein, 4 aa, Artificial Sequence
  RECOMBINANT FURIN CLEAVAGE SITE
RRAN

SEQ ID NO: 18 - protein, 4 aa, Artificial Sequence
  RECOMBINANT FURIN CLEAVAGE SITE
NNAR

SEQ ID NO: 19 - protein, 4 aa, Artificial Sequence
  RECOMBINANT FURIN CLEAVAGE SITE
RNAN

SEQ ID NO: 20 - protein, 4 aa, Artificial Sequence
  RECOMBINANT FURIN CLEAVAGE SITE
NRAN

SEQ ID NO: 21 - protein, 4 aa, Artificial Sequence
  RECOMBINANT FURIN CLEAVAGE SITE
AAAA

SEQ ID NO: 22 - protein, 4 aa, Artificial Sequence
  RECOMBINANT FURIN CLEAVAGE SITE
ARAR

SEQ ID NO: 23 - protein, 4 aa, Artificial Sequence
  RECOMBINANT FURIN CLEAVAGE SITE
RAAR

SEQ ID NO: 24 - protein, 4 aa, Artificial Sequence
  RECOMBINANT FURIN CLEAVAGE SITE
RRAA

SEQ ID NO: 25 - protein, 4 aa, Artificial Sequence
  RECOMBINANT FURIN CLEAVAGE SITE
AAAR

SEQ ID NO: 26 - protein, 4 aa, Artificial Sequence
  RECOMBINANT FURIN CLEAVAGE SITE
RAAA

SEQ ID NO: 27 - protein, 4 aa, Artificial Sequence
  RECOMBINANT FURIN CLEAVAGE SITE
ARAA

SEQ ID NO: 28 - protein, 4 aa, Artificial Sequence
  RECOMBINANT FURIN CLEAVAGE SITE
GGAG

SEQ ID NO: 29 - protein, 4 aa, Artificial Sequence
  RECOMBINANT FURIN CLEAVAGE SITE
GRAR

SEQ ID NO: 30 - protein, 4 aa, Artificial Sequence
  RECOMBINANT FURIN CLEAVAGE SITE
RGAR

SEQ ID NO: 31 - protein, 4 aa, Artificial Sequence
  RECOMBINANT FURIN CLEAVAGE SITE
RRAG

SEQ ID NO: 32 - protein, 4 aa, Artificial Sequence
  RECOMBINANT FURIN CLEAVAGE SITE
GGAR

SEQ ID NO: 33 - protein, 4 aa, Artificial Sequence
  RECOMBINANT FURIN CLEAVAGE SITE
RGAG

SEQ ID NO: 34 - protein, 4 aa, Artificial Sequence
  RECOMBINANT FURIN CLEAVAGE SITE
GRAG

SEQ ID NO: 35 - DNA, 3819 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacc

SEQ ID NO: 36 - protein, 1279 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHHH

SEQ ID NO: 37 - DNA, 3837 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacccaccaccaccaccaccac

SEQ ID NO: 38 - protein, 1266 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHHH

SEQ ID NO: 39 - protein, 60 aa, Artificial Sequence
  RECOMBINANT SPIKE PROTEIN
WYIWLGFIAGLIAIVMVTIMLCCMTSCCSCLKGCCSCGSCCKFDEDDSEPVLKGVKLHYT

SEQ ID NO: 40 - protein, 1213 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWP

SEQ ID NO: 41 - protein, 1200 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWP

SEQ ID NO: 42 - protein, 1219 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 43 - DNA, 3657 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggcctcaccaccaccaccaccac

SEQ ID NO: 44 - protein, 1219 aa, Artificial Sequence; identical to SEQ ID NO: 42
  RECOMBINANT SPIKE PROTEIN

SEQ ID NO: 45 - protein, 318 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPN

SEQ ID NO: 46 - protein, 955 aa, Artificial Sequence
  RECOMBINANT SPIKE PROTEIN
MFVFLVLLPLVSSITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 47 - DNA, 2868 bp, Artificial Sequence
  RECOMBINANT SPIKE PROTEIN
atgttcgtcttcctggtgctgctgcccctggtgtccagcatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacctaa

SEQ ID NO: 48 - protein, 942 aa, Artificial Sequence
  RECOMBINANT SPIKE PROTEIN
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 49 - protein, 960 aa, Artificial Sequence
  RECOMBINANT SPIKE PROTEIN
MFVFLVLLPLVSSITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHH

SEQ ID NO: 50 - DNA, 2883 bp, Artificial Sequence
  RECOMBINANT SPIKE PROTEIN
atgttcgtcttcctggtgctgctgcccctggtgtccagcatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacccaccaccaccaccaccac

SEQ ID NO: 51 - protein, 947 aa, Artificial Sequence
  RECOMBINANT SPIKE PROTEIN
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHH

SEQ ID NO: 52 - protein, 901 aa, Artificial Sequence
  RECOMBINANT SPIKE PROTEIN
MFVFLVLLPLVSSITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 53 - DNA, 2706 bp, Artificial Sequence
  RECOMBINANT SPIKE PROTEIN
atgttcgtcttcctggtgctgctgcccctggtgtccagcatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggcctcaccaccaccaccaccaccac

SEQ ID NO: 54 - protein, 888 aa, Artificial Sequence
  RECOMBINANT SPIKE PROTEIN
ITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 55 - DNA, 3819 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacagcaggctcagtctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacc

SEQ ID NO: 56 - protein, 1279 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHHH

SEQ ID NO: 57 - DNA, 3837 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacagcaggctcagtctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacccaccaccaccaccaccac

SEQ ID NO: 58 - protein, 1266 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTHHHHHH

SEQ ID NO: 59 - protein, 1219 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 60 - DNA, 3657 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacagcaggctcagtctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggcctcaccaccaccaccaccac

SEQ ID NO: 61 - protein, 1205 aa, Artificial Sequence
  RECOMBINANT SPIKE PROTEIN
CVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 62 - protein, 1263 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVALGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 63 - protein, 1250 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVALGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 64 - protein, 1263 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 65 - protein, 1250 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 66 - protein, 1263 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 67 - protein, 1250 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 68 - protein, 31 aa, Artificial Sequence
  Foldon
SAIGGYIPEAPRDGQAYVRKDGEWVLLSTFL

SEQ ID NO: 69 - protein, 202 aa, Betacoronavirus severe acute respiratory syndrome coronavirus 2
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKK

SEQ ID NO: 70 - protein, 201 aa, Betacoronavirus Severe acute respiratory syndrome-related coronavirus
RFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKL

SEQ ID NO: 71 - protein, 239 aa, Betacoronavirus Middle East respiratory syndrome-related coronavirus
FEAKPSGSVVAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEY

SEQ ID NO: 72 - protein, 544 aa, Artificial Sequence
  RECOMBINANT SPIKE PROTEIN
MFVFLVLLPLVSSRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTERFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSAIGGYIPEAPRDGQAYVRKDGEWVLLSTFLHHHHHH

SEQ ID NO: 73 - protein, 531 aa, Artificial Sequence
  RECOMBINANT SPIKE PROTEIN
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTERFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSAIGGYIPEAPRDGQAYVRKDGEWVLLSTFLHHHHHH

SEQ ID NO: 74 - protein, 544 aa, Artificial Sequence; identical to SEQ ID NO: 72
  RECOMBINANT SPIKE PROTEIN

SEQ ID NO: 75 - protein, 531 aa, Artificial Sequence; identical to SEQ ID NO: 73
  RECOMBINANT SPIKE PROTEIN

SEQ ID NO: 76 - protein, 470 aa, Artificial Sequence
  RECOMBINANT SPIKE PROTEIN
MFVFLVLLPLVSSRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFLHHHHHH

SEQ ID NO: 77 - protein, 464 aa, Artificial Sequence
  RECOMBINANT SPIKE PROTEIN
MFVFLVLLPLVSSRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFL

SEQ ID NO: 78 - protein, 457 aa, Artificial Sequence
  RECOMBINANT SPIKE PROTEIN
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFLHHHHHH

SEQ ID NO: 79 - protein, 451 aa, Artificial Sequence
  RECOMBINANT SPIKE PROTEIN
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFL

SEQ ID NO: 80 - protein, 726 aa, Artificial Sequence
  RECOMBINANT SPIKE PROTEIN
MFVFLVLLPLVSSRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSFEAKPSGSVVAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFLHHHHHH

SEQ ID NO: 81 - protein, 720 aa, Artificial Sequence
  RECOMBINANT SPIKE PROTEIN
MFVFLVLLPLVSSRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSFEAKPSGSVVAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFL

SEQ ID NO: 82 - protein, 713 aa, Artificial Sequence
  RECOMBINANT SPIKE PROTEIN
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSFEAKPSGSVVAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFLHHHHHH

SEQ ID NO: 83 - protein, 707 aa, Artificial Sequence
  RECOMBINANT SPIKE PROTEIN
RFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSGGGSGGGSGGGSGGGSFEAKPSGSVVAEGVECDFSPLLSGTPPQVYNFKRLVFTNCNYNLTKLLSLFSVNDFTCSQISPAAIASNCYSSLILDYFSYPLSMKSDLSVSSAGPISQFNYKQSFSNPTCLILATVPHNLTTITKPLKYSYINKCSRLLSDDRTEVPQLVNANQYSPCVSIVPSTVWEDGDYYRKQLSPLEGGGWLVASGSTVAMTEQLQMGFGITVQYGTDTNSVCPKLEFANDTKIASQLGNCVEYSGGGSGGGSGGGSGGGSRFPNITNLCPFGEVFNATKFPSVYAWERKKISNCVADYSVLYNSTFFSTFKCYGVSATKLNDLCFSNVYADSFVVKGDDVRQIAPGQTGVIADYNYKLPDDFMGCVLAWNTRNIDATSTGNYNYKYRYLRHGKLRPFERDISNVPFSPDGKPCTPPALNCYWPLNDYGFYTTTGIGYQPYRVVVLSFELLNAPATVCGPKLSAIGGYIPEAPRDGQAYVRKDGEWVLLSTFL

SEQ ID NO: 84 - protein, 1273 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 85 - protein, 1260 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 86 - protein, 1273 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 87 - protein, 1260 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 88 - protein, 1219 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 89 - protein, 1206 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPHHHHHH

SEQ ID NO: 90 - protein, 17 aa, Artificial Sequence
  Linker
SGGGSGGGSGGGSGGGS

SEQ ID NO: 91 - protein, 4 aa, Artificial Sequence
  Linker
SGGG

SEQ ID NO: 92 - protein, 4 aa, Artificial Sequence
  Linker
GGGS

SEQ ID NO: 93 - protein, 5 aa, Artificial Sequence
  Linker
GGGGS

SEQ ID NO: 94 - protein, 90 aa, Artificial Sequence
  RECOMBINANT SPIKE PROTEIN
STNLVKNKCVNFNFNGLTGTGVLTESNKKFLPFQQFGRDIADTTDAVRDPQTLEILDITPCSFGGVSVITPGTNTSNQVAVLYQDVNCTE

SEQ ID NO: 95 - DNA, 3639 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacgcagggctcgctctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggacaaggtcgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggcct

SEQ ID NO: 96 - DNA, 3822 bp, Artificial Sequence
  RECOMBINANT SPIKE PROTEIN
atgttcgtcttcctggtgctgctgcccctggtgtccagccagtgcgtgaacctgaccactaggactcagctgcctcccgcttacaccaactcattcactcgcggtgtgtactaccctgacaaggtcttccgttcttcagtgctgcactcaactcaggacctgttcctgcccttcttctccaacgtcacctggttccacgccatccacgtgtccggcaccaacggcactaagcgcttcgacaacccagtgctgcctttcaacgacggtgtctacttcgcttcaaccgagaagtccaacatcatccgtggatggatcttcggcaccactctggacagcaagactcagtctctgctgatcgtcaacaacgccaccaacgtggtcatcaaggtctgcgaattccagttctgcaacgacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgagggagttcgtgttcaagaacatcgacggatacttcaagatttacagcaagcacaccccaatcaacctggtgcgcgacctgcctcagggtttctctgctctggagccactggtggacctgcctatcggcatcaacatcacccgcttccagactctgctggctctgcaccgttcctacctgactccaggcgactcatcttctggatggactgctggagctgctgcttactacgtgggctacctgcagcctcgcaccttcctgctgaagtacaacgaaaacggaaccatcactgacgccgtcgactgcgctctggaccctctgtcagaaaccaagtgcactctgaagtccttcaccgtggagaagggcatctaccagacttcaaacttcagggtgcagcccaccgaatccatcgtcagattccctaacatcactaacctgtgccccttcggagaggtcttcaacgccacccgcttcgcttccgtgtacgcctggaacaggaagagaatctcaaactgcgtcgctgactactccgtgctgtacaactcagcctccttcagcaccttcaagtgctacggcgtgtcaccaactaagctgaacgacctgtgcttcaccaacgtctacgccgactccttcgtgatcaggggagacgaggtcagacagatcgctcctggccagactggaaagatcgccgactacaactacaagctgcccgacgacttcaccggttgcgtcatcgcttggaacagcaacaacctggactctaaagtgggtggcaactacaactacctgtaccgcctgttccgtaagtcaaacctgaagccattcgagagggacatcagcactgaaatctaccaggccggatctaccccttgcaacggtgtcgagggcttcaactgctacttccccctgcagtcctacggtttccagccaactaacggtgtgggctaccagccttacagagtggtcgtgctgagcttcgaactgctccacgctcctgctactgtgtgcggtccaaagaagtctaccaacctggtcaagaacaagtgcgtgaacttcaacttcaacggcctgaccggaactggtgtcctgaccgagagcaacaagaagttcctgcccttccagcagttcggaagggacatcgctgacaccactgacgctgtgcgcgaccctcagaccctggaaatcctggacatcactccatgctcattcggaggtgtctccgtgatcacccctggcaccaacacttctaaccaggtcgctgtgctgtaccaggacgtcaactgcaccgaggtccctgtggccatccacgctgaccagctgacccccacttggcgcgtgtactccaccggcagcaacgtgttccagactcgtgctggttgcctgatcggcgccgagcacgtgaacaacagctacgaatgcgacatccccatcggcgctggaatctgcgcctcttaccagacccagactaacagcccacagcaggctcagtctgtggcctctcagtcaatcatcgcttacaccatgtcactgggcgctgaaaactccgtggcctactctaacaactcaatcgccatccccaccaacttcactatcagcgtgaccactgagatcctgccagtcagcatgaccaagacttctgtggactgcactatgtacatctgcggagacagcaccgaatgctctaacctgctgctgcagtacggctctttctgcacccagctgaaccgtgctctgactggaatcgccgtggagcaggacaagaacactcaggaagtcttcgctcaggtgaagcaaatctacaagaccccacctatcaaggacttcggcggattcaacttctcccagatcctgcctgacccctccaagccaagcaagcgctctttcatcgaggacctgctgttcaacaaggtcactctggccgacgctggattcatcaagcagtacggagactgcctgggtgacatcgccgctcgtgacctgatctgcgctcagaagttcaacggtctgaccgtgctgcccccactgctgactgacgaaatgatcgcccagtacactagcgccctgctggctggaaccatcacttctggttggaccttcggtgctggcgccgctctgcagatccctttcgctatgcagatggcctaccgtttcaacggaatcggtgtcacccagaacgtgctgtacgagaaccagaagctgatcgctaaccagttcaactcagccatcggaaagatccaggacagcctgagctctactgcctctgctctgggcaagctgcaggacgtcgtgaaccagaacgcccaggctctgaacaccctggtcaagcagctgtcatccaacttcggtgctatcagctctgtgctgaacgacatcctgtcccgcctggaccctcccgaggccgaagtgcagatcgaccgcctgatcactggccgtctgcagtcactgcagacctacgtgactcagcagctgatcagggccgctgaaatcagagcctccgctaacctggccgctaccaagatgagcgagtgcgtcctgggtcaatctaagcgtgtggacttctgcggcaagggataccacctgatgtcattccctcagtctgctccccacggtgtggtgttcctgcacgtcacctacgtgccagcccaggagaagaacttcaccactgcccctgctatctgccacgacggcaaggctcacttccccagggaaggtgtcttcgtgagcaacggcacccactggttcgtcactcagagaaacttctacgagccacagatcatcaccactgacaacactttcgtgtctggaaactgcgacgtggtcatcggtatcgtcaacaacaccgtgtacgaccccctgcagccagagctggactcattcaaggaggaactggacaagtacttcaagaaccacacctcccctgacgtcgacctgggcgacatctcaggaatcaacgcttccgtcgtgaacatccagaaggagatcgaccgcctgaacgaagtggccaagaacctgaacgaaagcctgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactctgaacccgtcctgaagggcgtgaagctgcactacacctaa

SEQ ID NO: 97 - protein, 4 aa, Artificial Sequence
  Recombinant Furin Cleavage Site
GSAS

SEQ ID NO: 98 - protein, 8 aa, Artificial Sequence
  HRV3C Cleavage Site
LEVLFQGP

SEQ ID NO: 99 - protein, 8 aa, Artificial Sequence
  Strep-tag
WSHPQFEK

SEQ ID NO: 100 - protein, 6 aa, Artificial Sequence
  6X-His Tag
HHHHHH

SEQ ID NO: 101 - protein, 10 aa, Artificial Sequence
  His-Tag
  SITE (6)..(6): May be present or absent
  SITE (7)..(7): May be present or absent
  SITE (8)..(8): May be present or absent
  SITE (9)..(9): May be present or absent
  SITE (10)..(10): May be present or absent
HHHHHHHHHH

SEQ ID NO: 102 - protein, 8 aa, Artificial Sequence
  8X-His Tag
HHHHHHHH

SEQ ID NO: 103 - protein, 30 aa, Artificial Sequence
  FOLDON
GYIPEAPRDGQAYVRKDGEWVLLSTFLSPA

SEQ ID NO: 104 - protein, 10 aa, Artificial Sequence
  RECOMBINANT SPIKE PROTEIN
EDLLFNKVTL

SEQ ID NO: 105 - protein, 1263 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 106 - protein, 1250 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 107 - protein, 1263 aa, Artificial Sequence
  RECOMBINANT SPIKE PROTEIN
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 108 - protein, 1250 aa, Artificial Sequence
  RECOMBINANT SPIKE PROTEIN
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 109 - protein, 1273 aa, Artificial Sequence
  Recombinant CoV S polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 110 - protein, 1260 aa, Artificial Sequence
  Recombinant CoV S polypeptide
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPGSASSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 111 - protein, 4 aa, Artificial Sequence
  Recombinant Furin Cleavage Site
GSGA

SEQ ID NO: 112 - protein, 1260 aa, Artificial Sequence
  Recombinant SARS-CoV-2 spike protein
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 113 - protein, 1260 aa, Artificial Sequence
  Recombinant SARS-CoV-2 spike protein
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 114 - protein, 1257 aa, Artificial Sequence
  Recombinant SARS-CoV-2 spike protein
QCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 115 - protein, 1260 aa, Artificial Sequence
  Recombinant SARS-CoV-2 spike protein
QCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 116 - protein, 196 aa, Betacoronavirus severe acute respiratory syndrome coronavirus 2
LCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKS

SEQ ID NO: 117 - protein, 13 aa, Artificial Sequence
  signal peptide
MFVFLVLLPLVSI

SEQ ID NO: 118 - protein, 292 aa, Betacoronavirus severe acute respiratory syndrome coronavirus 2
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKS

SEQ ID NO: 119 - protein, 83 aa, Betacoronavirus severe acute respiratory syndrome coronavirus 2
MAYRFNGIGVTQNVLYENQKLIANQFNSAIGKIQDSLSSTASALGKLQDVVNQNAQALNTLVKQLSSNFGAISSVLNDILSRL

SEQ ID NO: 120 - protein, 588 aa, Betacoronavirus severe acute respiratory syndrome coronavirus 2
SVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 121 - protein, 672 aa, Betacoronavirus severe acute respiratory syndrome coronavirus 2
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRAR

SEQ ID NO: 122 - protein, 140 aa, Betacoronavirus severe acute respiratory syndrome coronavirus 2
NFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSP

SEQ ID NO: 123 - protein, 24 aa, Betacoronavirus severe acute respiratory syndrome coronavirus 2
WYIWLGFIAGLIAIVMVTIMLCCM

SEQ ID NO: 124 - protein, 36 aa, Betacoronavirus severe acute respiratory syndrome coronavirus 2
TSCCSCLKGCCSCGSCCKFDEDDSEPVLKGVKLHYT

SEQ ID NO: 125 - protein, 51 aa, Betacoronavirus severe acute respiratory syndrome coronavirus 2
DVDLGDISGINASVVNIQKEIDRLNEVAKNLNESLIDLQELGKYEQYIKWP

SEQ ID NO: 126 - protein, 197 aa, Betacoronavirus severe acute respiratory syndrome coronavirus 2
NITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGP

SEQ ID NO: 127 - protein, 3 aa, Artificial Sequence
  inactivated furin cleavage site
GGG

SEQ ID NO: 128 - protein, 4 aa, Artificial Sequence
  inactivated furin cleavage site
GGGG

SEQ ID NO: 129 - protein, 5 aa, Artificial Sequence
  inactivated furin cleavage site
GGGGG

SEQ ID NO: 130 - protein, 1272 aa, Artificial Sequence
  modified coronavirus S polypeptide
MFVFLVLLPLVSSQCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 131 - DNA, 3822 bp, Artificial Sequence
  modified coronavirus S polypeptide
atgttcgtcttcctggtgctgctgcctctggtgtccagccagtgcgtgaacctgaccactaggactcagctgcctcccgcttacaccaactcattcactaggggtgtgtactacccagacaaggtcttccgctcctcagtgctgcactcaactcaggacctgttcctgcctttcttctccaacgtcacctggttccacgctatccacgtgtccggcaccaacggcactaagaggttcgccaaccccgtgctgccattcaacgacggagtctacttcgcttcaaccgagaagtccaacatcatcagaggatggatcttcggcaccactctggacagcaagactcagtctctgctgatcgtcaacaacgctaccaacgtggtcatcaaggtgtgcgaattccagttctgtaacgaccccttcctgggtgtctactaccacaagaacaacaagtcatggatggagtccgaattccgcgtctactccagcgctaacaactgcactttcgagtacgtgtcccagccattcctgatggacctggaaggaaagcagggtaacttcaagaacctgcgcgagttcgtgttcaagaacatcgacggctacttcaagatttacagcaagcacacccccatcaacctggtccgtggcctgccacagggattctctgctctggagcccctggtggacctgccaatcggcatcaacatcaccaggttccagactctgcacgccctgcacagatcctacctgactcccggagactcttcatccggttggaccgctggcgctgccgcttactacgtgggttacctgcagccacgcaccttcctgctgaagtacaacgaaaacggcaccatcactgacgccgtcgactgcgctctggacccactgtcagaaaccaagtgcactctgaagtccttcaccgtggagaagggaatctaccagacttcaaacttccgcgtgcagcctaccgaatccatcgtccgtttcccaaacatcactaacctgtgccctttcggagaggtcttcaacgccacccgcttcgcttccgtgtacgcctggaaccgcaagcgtatctcaaactgcgtcgctgactactccgtgctgtacaactcagcctccttcagcaccttcaagtgctacggagtgtcacccactaagctgaacgacctgtgcttcaccaacgtctacgctgactccttcgtgatccgcggtgacgaggtccgtcagatcgctccaggccagactggaaacatcgccgactacaactacaagctgcctgacgacttcaccggttgcgtcatcgcctggaacagcaacaacctggactctaaagtgggtggcaactacaactacctgtacaggctgttcagaaagtcaaacctgaagcccttcgagcgcgacatcagcactgaaatctaccaggctggttctaccccatgcaacggtgtcaagggcttcaactgctacttccctctgcagtcctacggcttccagcccacttacggtgtgggctaccagccataccgtgtggtcgtgctgagcttcgagctgctgcacgcccctgctactgtgtgcggacccaagaagtctaccaacctggtcaagaacaagtgcgtgaacttcaacttcaacggtctgaccggaactggtgtcctgaccgagagcaacaagaagttcctgcctttccagcagttcggtcgcgacatcgctgacaccactgacgccgtgcgtgaccctcagaccctggaaatcctggacatcactccctgctcattcggaggtgtctccgtgatcactcccggaaccaacacttctaaccaggtcgctgtgctgtaccagggtgtgaactgcaccgaagtcccagtggccatccacgctgaccagctgacccctacttggagggtgtactccaccggcagcaacgtcttccagactagagctggatgcctgatcggtgccgagcacgtcaacaacagctacgaatgcgacatccctatcggcgctggaatctgcgcctcttaccagacccagactaacagcccccagcaggctcagtctgtggcctctcagtcaatcatcgcctacaccatgtcactgggtgtcgaaaactccgtggcttactctaacaactcaatcgccatccctaccaacttcactatcagcgtgaccactgagatcctgcccgtcagcatgaccaagacttctgtggactgcactatgtacatctgcggcgacagcaccgaatgctctaacctgctgctgcagtacggttctttctgcacccagctgaaccgcgctctgactggcatcgccgtggagcaggacaagaacactcaggaagtcttcgctcaggtgaagcaaatctacaagaccccacctatcaaggacttcggcggattcaacttctcccagatcctgccagacccttccaagcccagcaagaggtctttcatcgaggacctgctgttcaacaaggtcactctggccgacgctggtttcatcaagcagtacggcgactgcctgggagacatcgctgctcgcgacctgatctgcgcccagaagttcaacggcctgaccgtgctgcccccactgctgactgacgaaatgatcgctcagtacactagcgccctgctggctggcaccatcacttcaggttggactttcggtgctggtgctgctctgcagatcccattcgctatgcagatggcctaccgtttcaacggaatcggtgtcacccagaacgtgctgtacgagaaccagaagctgatcgctaaccagttcaactcagccatcggcaagatccaggacagcctgagctctactgcctctgctctgggaaagctgcaggacgtcgtgaaccagaacgcccaggctctgaacaccctggtcaagcagctgtcatccaacttcggcgccatcagctctgtgctgaacgacatcctgtccaggctggaccctcccgaggctgaagtccagatcgacaggctgatcactggaagactgcagtcactgcagacctacgtgactcagcagctgatccgcgccgctgaaatccgtgcctccgctaacctggccgctaccaagatgagcgagtgcgtcctgggccagtctaagagagtggacttctgcggcaagggataccacctgatgtcattcccacagtccgcccctcacggagtcgtgttcctgcacgtcacctacgtgcccgctcaggagaagaacttcaccactgccccagctatctgccacgacggcaaggctcacttccctcgcgaaggagtcttcgtgagcaacggcacccactggttcgtcactcagcgtaacttctacgagccccagatcatcaccactgacaacactttcgtgtctggcaactgcgacgtggtcatcggtatcgtcaacaacaccgtgtacgaccctctgcagcccgagctggactcattcaaggaagagctggacaagtacttcaagaaccacacctcccctgacgtcgacctgggtgacatctcaggcatcaacgcctccgtcgtgaacatccagaaggagatcgaccgcctgaacgaagtggctaagaacctgaacgaaagcctgatcgacctgcaggagctgggcaagtacgaacagtacatcaagtggccatggtacatctggctgggattcatcgctggcctcatcgctatcgtgatggtgaccatcatgctgtgctgcatgacttcatgctgctcctgcctgaagggttgctgcagctgcggctcttgctgcaagttcgacgaggacgactctgaacctgtcctgaagggagtgaagctgcactacacctaa

SEQ ID NO: 132 - protein, 1259 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 133 - protein, 1258 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 134 - protein, 1271 aa, Artificial Sequence
  modified coronavirus S polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 135 - protein, 3813 aa, Artificial Sequence
  modified coronavirus S polypeptide
ATGTTCGTCTTCCTGGTGCTGCTGCCTCTGGTGTCCAGCCAGTGCGTGAACCTGACCACTAGGACTCAGCTGCCTCCCGCTTACACCAACAGCTTCACTAGGGGTGTCTACTACCCTGACAAGGTCTTCCGCTCCTCAGTGCTGCACTCTACTCAGGACCTGTTCCTGCCCTTCTTCTCAAACGTGACCTGGTTCCACGCCATCTCCGGCACCAACGGCACTAAGAGGTTCGACAACCCCGTGCTGCCATTCAACGACGGCGTCTACTTCGCTTCAACCGAGAAGTCCAACATCATCAGAGGATGGATCTTCGGCACCACTCTGGACAGCAAGACTCAGTCTCTGCTGATCGTCAACAACGCCACCAACGTGGTCATCAAGGTGTGCGAATTCCAGTTCTGCAACGACCCATTCCTGGGTGTGTACCACAAGAACAACAAGTCATGGATGGAGTCCGAATTCCGCGTCTACTCCAGCGCTAACAACTGCACTTTCGAGTACGTGAGCCAGCCTTTCCTGATGGACCTGGAAGGAAAGCAGGGTAACTTCAAGAACCTGCGCGAGTTCGTGTTCAAGAACATCGACGGATACTTCAAGATTTACAGCAAGCACACCCCCATCAACCTGGTCCGTGACCTGCCACAGGGTTTCTCTGCTCTGGAGCCCCTGGTGGACCTGCCAATCGGCATCAACATCACCAGGTTCCAGACTCTGCTGGCTCTGCACCGCTCCTACCTGACTCCAGGTGACTCATCTTCTGGATGGACTGCTGGAGCTGCTGCTTACTACGTGGGTTACCTGCAGCCTCGCACCTTCCTGCTGAAGTACAACGAAAACGGCACCATCACTGACGCCGTCGACTGCGCTCTGGACCCTCTGTCAGAAACCAAGTGCACTCTGAAGTCCTTCACCGTGGAGAAGGGTATCTACCAGACTAGCAACTTCCGCGTGCAGCCCACCGAATCTATCGTCCGTTTCCCAAACATCACTAACCTGTGCCCTTTCGGCGAGGTCTTCAACGCCACCCGCTTCGCTTCCGTGTACGCCTGGAACCGCAAGCGTATCTCAAACTGCGTCGCTGACTACTCCGTGCTGTACAACTCAGCCTCCTTCAGCACCTTCAAGTGCTACGGTGTGTCACCCACTAAGCTGAACGACCTGTGCTTCACCAACGTCTACGCCGACTCCTTCGTGATCCGCGGCGACGAGGTCCGTCAGATCGCTCCAGGCCAGACTGGAAAGATCGCCGACTACAACTACAAGCTGCCTGACGACTTCACCGGCTGCGTCATCGCTTGGAACAGCAACAACCTGGACTCTAAAGTGGGTGGCAACTACAACTACCTGTACAGGCTGTTCAGAAAGAGCAACCTGAAGCCCTTCGAGCGCGACATCAGCACTGAAATCTACCAGGCTGGCTCTACCCCATGCAACGGTGTCGAGGGCTTCAACTGCTACTTCCCTCTGCAGTCTTACGGATTCCAGCCCACTTACGGTGTGGGCTACCAGCCATACCGTGTGGTCGTGCTGAGCTTCGAACTGCTGCACGCCCCTGCTACTGTGTGCGGACCCAAGAAGTCTACCAACCTGGTCAAGAACAAGTGCGTGAACTTCAACTTCAACGGTCTGACCGGAACTGGTGTCCTGACCGAGAGCAACAAGAAGTTCCTGCCCTTCCAGCAGTTCGGTCGCGACATCGACGACACCACTGACGCCGTGCGTGACCCTCAGACCCTGGAAATCCTGGACATCACTCCCTGCTCATTCGGAGGTGTCTCCGTGATCACTCCAGGAACCAACACTTCTAACCAGGTCGCTGTGCTGTACCAGGGTGTCAACTGCACCGAGGTCCCAGTGGCCATCCACGCTGACCAGCTGACCCCTACTTGGAGGGTGTACTCCACCGGCAGCAACGTGTTCCAGACTAGAGCTGGTTGCCTGATCGGCGCCGAGCACGTGAACAACAGCTACGAATGCGACATCCCAATCGGCGCTGGAATCTGCGCCTCTTACCAGACCCAGACTAACAGCCACCAGCAGGCTCAGTCTGTCGCCTCTCAGTCAATCATCGCTTACACTATGTCACTGGGCGCTGAAAACTCCGTGGCCTACTCTAACAACTCAATCGCCATCCCTATCAACTTCACCATCTCAGTGACCACTGAGATCCTGCCCGTCAGCATGACCAAGACTTCTGTGGACTGCACTATGTACATCTGCGGAGACAGCACCGAATGCTCTAACCTGCTGCTGCAGTACGGCTCCTTCTGCACCCAGCTGAACCGCGCTCTGACTGGAATCGCCGTGGAGCAGGACAAGAACACTCAGGAAGTCTTCGCTCAGGTGAAGCAAATCTACAAGACCCCACCTATCAAGGACTTCGGCGGATTCAACTTCTCCCAGATCCTGCCAGACCCTTCCAAGCCAAGCAAGAGGTCTTTCATCGAGGACCTGCTGTTCAACAAGGTCACCCTGGCCGACGCTGGCTTCATCAAGCAGTACGGAGACTGCCTGGGTGACATCGCCGCTCGCGACCTGATCTGCGCTCAGAAGTTCAACGGACTGACCGTGCTGCCCCCACTGCTGACTGACGAAATGATCGCCCAGTACACTTCAGCCCTGCTGGCTGGAACCATCACTTCTGGTTGGACCTTCGGTGCTGGTGCTGCTCTGCAGATCCCTTTCGCTATGCAGATGGCCTACCGTTTCAACGGAATCGGTGTCACCCAGAACGTGCTGTACGAGAACCAGAAGCTGATCGCTAACCAGTTCAACTCCGCCATCGGCAAGATCCAGGACAGCCTGAGCTCTACTGCCTCTGCTCTGGGAAAGCTGCAGGACGTCGTGAACCAGAACGCCCAGGCTCTGAACACCCTGGTCAAGCAGCTGTCATCCAACTTCGGAGCCATCAGCTCTGTGCTGAACGACATCCTCGCTAGGCTGGACCCTCCCGAGGCTGAAGTCCAGATCGACAGGCTGATCACTGGTAGACTGCAGTCACTGCAGACCTACGTGACTCAGCAGCTGATCCGCGCCGCTGAAATCCGTGCCTCCGCTAACCTGGCCGCTACCAAGATGAGCGAGTGCGTCCTGGGACAGTCTAAGAGAGTGGACTTCTGCGGCAAGGGATACCACCTGATGTCATTCCCACAGTCCGCTCCTCACGGTGTCGTGTTCCTGCACGTCACCTACGTGCCCGCCCAGGAGAAGAACTTCACCACTGCCCCAGCTATCTGCCACGACGGCAAGGCTCACTTCCCCCGCGAAGGTGTCTTCGTGTCAAACGGCACCCACTGGTTCGTCACTCAGCGTAACTTCTACGAGCCACAGATCATCACCACTCACAACACTTTCGTGTCCGGAAACTGCGACGTGGTCATCGGTATCGTCAACAACACCGTGTACGACCCTCTGCAGCCCGAGCTGGACTCATTCAAGGAAGAGCTGGACAAGTACTTCAAGAACCACACCTCCCCTGACGTCGACCTGGGCGACATCTCAGGAATCAACGCTTCCGTCGTGAACATCCAGAAGGAGATCGACCGCCTGAACGAAGTGGCCAAGAACCTGAACGAATCACTGATCGACCTGCAGGAGCTGGGCAAGTACGAACAGTACATCAAGTGGCCTTGGTACATCTGGCTGGGTTTCATCGCTGGCCTCATCGCTATCGTGATGGTGACCATCATGCTGTGCTGCATGACTTCATGCTGCTCCTGCCTGAAGGGCTGCTGCAGCTGCGGATCTTGCTGCAAGTTCGACGAGGACGACTCCGAACCCGTCCTGAAGGGAGTGAAGCTGCACTACACCTAA

SEQ ID NO: 136 - protein, 1270 aa, Artificial Sequence
  modified coronavirus S polypeptide
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 137 - protein, 1268 aa, Artificial Sequence
  modified coronavirus S polypeptide
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHGGSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 138 - protein, 1255 aa, Artificial Sequence
  modified coronavirus S polypeptide
QCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHGGSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 139 - DNA, 3807 bp, Artificial Sequence
  modified coronavirus S polypeptide
atgttcgtcttcctggtgctgctgcctctggtgtccagccagtgcgtgaacctgaccactaggactcagctgcctcccgcttacaccaacagcttcactaggggtgtctactaccctgacaaggtcttccgctcctcagtgctgcactctactcaggacctgttcctgcccttcttctcaaacgtgacctggttccacgccatctccggcaccaacggcactaagaggttcgacaaccccgtgctgccattcaacgacggcgtctacttcgcttcaaccgagaagtccaacatcatcagaggatggatcttcggcaccactctggacagcaagactcagtctctgctgatcgtcaacaacgccaccaacgtggtcatcaaggtgtgcgaattccagttctgcaacgacccattcctgggtgtgtaccacaagaacaacaagtcatggatggagtccgaattccgcgtctactccagcgctaacaactgcactttcgagtacgtgagccagcctttcctgatggacctggaaggaaagcagggtaacttcaagaacctgcgcgagttcgtgttcaagaacatcgacggatacttcaagatttacagcaagcacacccccatcaacctggtccgtgacctgccacagggtttctctgctctggagcccctggtggacctgccaatcggcatcaacatcaccaggttccagactctgctggctctgcaccgctcctacctgactccaggtgactcatcttctggatggactgctggagctgctgcttactacgtgggttacctgcagcctcgcaccttcctgctgaagtacaacgaaaacggcaccatcactgacgccgtcgactgcgctctggaccctctgtcagaaaccaagtgcactctgaagtccttcaccgtggagaagggtatctaccagactagcaacttccgcgtgcagcccaccgaatctatcgtccgtttcccaaacatcactaacctgtgccctttcggcgaggtcttcaacgccacccgcttcgcttccgtgtacgcctggaaccgcaagcgtatctcaaactgcgtcgctgactactccgtgctgtacaactcagcctccttcagcaccttcaagtgctacggtgtgtcacccactaagctgaacgacctgtgcttcaccaacgtctacgccgactccttcgtgatccgcggcgacgaggtccgtcagatcgctccaggccagactggaaagatcgccgactacaactacaagctgcctgacgacttcaccggctgcgtcatcgcttggaacagcaacaacctggactctaaagtgggtggcaactacaactacctgtacaggctgttcagaaagagcaacctgaagcccttcgagcgcgacatcagcactgaaatctaccaggctggctctaccccatgcaacggtgtcgagggcttcaactgctacttccctctgcagtcttacggattccagcccacttacggtgtgggctaccagccataccgtgtggtcgtgctgagcttcgaactgctgcacgcccctgctactgtgtgcggacccaagaagtctaccaacctggtcaagaacaagtgcgtgaacttcaacttcaacggtctgaccggaactggtgtcctgaccgagagcaacaagaagttcctgcccttccagcagttcggtcgcgacatcgacgacaccactgacgccgtgcgtgaccctcagaccctggaaatcctggacatcactccctgctcattcggaggtgtctccgtgatcactccaggaaccaacacttctaaccaggtcgctgtgctgtaccagggtgtcaactgcaccgaggtcccagtggccatccacgctgaccagctgacccctacttggagggtgtactccaccggcagcaacgtgttccagactagagctggttgcctgatcggcgccgagcacgtgaacaacagctacgaatgcgacatcccaatcggcgctggaatctgcgcctcttaccagacccagactaacagccacggtggttctgtcgcctctcagtcaatcatcgcttacactatgtcactgggcgctgaaaactccgtggcctactctaacaactcaatcgccatccctatcaacttcaccatctcagtgaccactgagatcctgcccgtcagcatgaccaagacttctgtggactgcactatgtacatctgcggagacagcaccgaatgctctaacctgctgctgcagtacggctccttctgcacccagctgaaccgcgctctgactggaatcgccgtggagcaggacaagaacactcaggaagtcttcgctcaggtgaagcaaatctacaagaccccacctatcaaggacttcggcggattcaacttctcccagatcctgccagacccttccaagccaagcaagaggtctttcatcgaggacctgctgttcaacaaggtcaccctggccgacgctggcttcatcaagcagtacggagactgcctgggtgacatcgccgctcgcgacctgatctgcgctcagaagttcaacggactgaccgtgctgcccccactgctgactgacgaaatgatcgcccagtacacttcagccctgctggctggaaccatcacttctggttggaccttcggtgctggtgctgctctgcagatccctttcgctatgcagatggcctaccgtttcaacggaatcggtgtcacccagaacgtgctgtacgagaaccagaagctgatcgctaaccagttcaactccgccatcggcaagatccaggacagcctgagctctactgcctctgctctgggaaagctgcaggacgtcgtgaaccagaacgcccaggctctgaacaccctggtcaagcagctgtcatccaacttcggagccatcagctctgtgctgaacgacatcctcgctaggctggaccctcccgaggctgaagtccagatcgacaggctgatcactggtagactgcagtcactgcagacctacgtgactcagcagctgatccgcgccgctgaaatccgtgcctccgctaacctggccgctaccaagatgagcgagtgcgtcctgggacagtctaagagagtggacttctgcggcaagggataccacctgatgtcattcccacagtccgctcctcacggtgtcgtgttcctgcacgtcacctacgtgcccgcccaggagaagaacttcaccactgccccagctatctgccacgacggcaaggctcacttcccccgcgaaggtgtcttcgtgtcaaacggcacccactggttcgtcactcagcgtaacttctacgagccacagatcatcaccactcacaacactttcgtgtccggaaactgcgacgtggtcatcggtatcgtcaacaacaccgtgtacgaccctctgcagcccgagctggactcattcaaggaagagctggacaagtacttcaagaaccacacctcccctgacgtcgacctgggcgacatctcaggaatcaacgcttccgtcgtgaacatccagaaggagatcgaccgcctgaacgaagtggccaagaacctgaacgaatcactgatcgacctgcaggagctgggcaagtacgaacagtacatcaagtggccttggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactccgaacccgtcctgaagggagtgaagctgcactacacctaa

SEQ ID NO: 140 - protein, 1270 aa, Artificial Sequence
  modified coronavirus S polypeptide
MFVFLVLLPLVSSQCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 141 - protein, 1257 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 142 - DNA, 3816 bp, Artificial Sequence
  modified coronavirus S polypeptide
atgttcgtcttcctggtgctgctgcctctggtgtccagccagtgcgtgaacctgaccactaggactcagctgcctcccgcttacaccaactcattcactaggggtgtgtactacccagacaaggtcttccgctcctcagtgctgcactcaactcaggacctgttcctgcctttcttctccaacgtcacctggttccacgctatccacgtgtccggcaccaacggcactaagaggttcgccaaccccgtgctgccattcaacgacggagtctacttcgcttcaaccgagaagtccaacatcatcagaggatggatcttcggcaccactctggacagcaagactcagtctctgctgatcgtcaacaacgctaccaacgtggtcatcaaggtgtgcgaattccagttctgtaacgaccccttcctgggtgtctactaccacaagaacaacaagtcatggatggagtccgaattccgcgtctactccagcgctaacaactgcactttcgagtacgtgtcccagccattcctgatggacctggaaggaaagcagggtaacttcaagaacctgcgcgagttcgtgttcaagaacatcgacggctacttcaagatttacagcaagcacacccccatcaacctggtccgtggcctgccacagggattctctgctctggagcccctggtggacctgccaatcggcatcaacatcaccaggttccagactctgcacgccctgcacagatcctacctgactcccggagactcttcatccggttggaccgctggcgctgccgcttactacgtgggttacctgcagccacgcaccttcctgctgaagtacaacgaaaacggcaccatcactgacgccgtcgactgcgctctggacccactgtcagaaaccaagtgcactctgaagtccttcaccgtggagaagggaatctaccagacttcaaacttccgcgtgcagcctaccgaatccatcgtccgtttcccaaacatcactaacctgtgccctttcggagaggtcttcaacgccacccgcttcgcttccgtgtacgcctggaaccgcaagcgtatctcaaactgcgtcgctgactactccgtgctgtacaactcagcctccttcagcaccttcaagtgctacggagtgtcacccactaagctgaacgacctgtgcttcaccaacgtctacgctgactccttcgtgatccgcggtgacgaggtccgtcagatcgctccaggccagactggaaacatcgccgactacaactacaagctgcctgacgacttcaccggttgcgtcatcgcctggaacagcaacaacctggactctaaagtgggtggcaactacaactacctgtacaggctgttcagaaagtcaaacctgaagcccttcgagcgcgacatcagcactgaaatctaccaggctggttctaccccatgcaacggtgtcaagggcttcaactgctacttccctctgcagtcctacggcttccagcccacttacggtgtgggctaccagccataccgtgtggtcgtgctgagcttcgagctgctgcacgcccctgctactgtgtgcggacccaagaagtctaccaacctggtcaagaacaagtgcgtgaacttcaacttcaacggtctgaccggaactggtgtcctgaccgagagcaacaagaagttcctgcctttccagcagttcggtcgcgacatcgctgacaccactgacgccgtgcgtgaccctcagaccctggaaatcctggacatcactccctgctcattcggaggtgtctccgtgatcactcccggaaccaacacttctaaccaggtcgctgtgctgtaccagggtgtgaactgcaccgaagtcccagtggccatccacgctgaccagctgacccctacttggagggtgtactccaccggcagcaacgtcttccagactagagctggatgcctgatcggtgccgagcacgtcaacaacagctacgaatgcgacatccctatcggcgctggaatctgcgcctcttaccagacccagactaacagcccaggtggttctgtggcctctcagtcaatcatcgcctacaccatgtcactgggtgtcgaaaactccgtggcttactctaacaactcaatcgccatccctaccaacttcactatcagcgtgaccactgagatcctgcccgtcagcatgaccaagacttctgtggactgcactatgtacatctgcggcgacagcaccgaatgctctaacctgctgctgcagtacggttctttctgcacccagctgaaccgcgctctgactggcatcgccgtggagcaggacaagaacactcaggaagtcttcgctcaggtgaagcaaatctacaagaccccacctatcaaggacttcggcggattcaacttctcccagatcctgccagacccttccaagcccagcaagaggtctttcatcgaggacctgctgttcaacaaggtcactctggccgacgctggtttcatcaagcagtacggcgactgcctgggagacatcgctgctcgcgacctgatctgcgcccagaagttcaacggcctgaccgtgctgcccccactgctgactgacgaaatgatcgctcagtacactagcgccctgctggctggcaccatcacttcaggttggactttcggtgctggtgctgctctgcagatcccattcgctatgcagatggcctaccgtttcaacggaatcggtgtcacccagaacgtgctgtacgagaaccagaagctgatcgctaaccagttcaactcagccatcggcaagatccaggacagcctgagctctactgcctctgctctgggaaagctgcaggacgtcgtgaaccagaacgcccaggctctgaacaccctggtcaagcagctgtcatccaacttcggcgccatcagctctgtgctgaacgacatcctgtccaggctggaccctcccgaggctgaagtccagatcgacaggctgatcactggaagactgcagtcactgcagacctacgtgactcagcagctgatccgcgccgctgaaatccgtgcctccgctaacctggccgctaccaagatgagcgagtgcgtcctgggccagtctaagagagtggacttctgcggcaagggataccacctgatgtcattcccacagtccgcccctcacggagtcgtgttcctgcacgtcacctacgtgcccgctcaggagaagaacttcaccactgccccagctatctgccacgacggcaaggctcacttccctcgcgaaggagtcttcgtgagcaacggcacccactggttcgtcactcagcgtaacttctacgagccccagatcatcaccactgacaacactttcgtgtctggcaactgcgacgtggtcatcggtatcgtcaacaacaccgtgtacgaccctctgcagcccgagctggactcattcaaggaagagctggacaagtacttcaagaaccacacctcccctgacgtcgacctgggtgacatctcaggcatcaacgcctccgtcgtgaacatccagaaggagatcgaccgcctgaacgaagtggctaagaacctgaacgaaagcctgatcgacctgcaggagctgggcaagtacgaacagtacatcaagtggccatggtacatctggctgggattcatcgctggcctcatcgctatcgtgatggtgaccatcatgctgtgctgcatgacttcatgctgctcctgcctgaagggttgctgcagctgcggctcttgctgcaagttcgacgaggacgactctgaacctgtcctgaagggagtgaagctgcactacacctaa

SEQ ID NO: 143 - protein, 1269 aa, Artificial Sequence
  modified coronavirus S polypeptide
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 144 - protein, 1256 aa, Artificial Sequence
  modified coronavirus S polypeptide
QCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 145 - DNA, 3812 bp, Artificial Sequence
  modified coronavirus S polypeptide
atgttcgtcttcctggtgctgctgcctctggtgtccagccagtgcgtgaacttcaccactaggactcagctgcctcccgcttacaccaactcattcactaggggtgtgtactacccagacaaggtcttccgctcctcagtgctgcactcaactcaggacctgttcctgcctttcttctccaacgtcacctggttccacgctatccacgtgtccggcaccaacggcactaagaggttcgccaaccccgtgctgccattcaacgacggagtctacttcgcttcaaccgagaagtccaacatcatcagaggatggatcttcggcaccactctggacagcaagactcagtctctgctgatcgtcaacaacgctaccaacgtggtcatcaaggtgtgcgaattccagttctgtaacgaccccttcctgggtgtctactaccacaagaacaacaagtcatggatggagtccgaattccgcgtctactccagcgctaacaactgcactttcgagtacgtgtcccagccattcctgatggacctggaaggaaagcagggtaacttcaagaacctgcgcgagttcgtgttcaagaacatcgacggctacttcaagatttacagcaagcacacccccatcaacctggtccgtggcctgccacagggattctctgctctggagcccctggtggacctgccaatcggcatcaacatcaccaggttccagactctgcacagatcctacctgactcccggagactcttcatccggttggaccgctggcgctgccgcttactacgtgggttacctgcagccacgcaccttcctgctgaagtacaacgaaaacggcaccatcactgacgccgtcgactgcgctctggacccactgtcagaaaccaagtgcactctgaagtccttcaccgtggagaagggaatctaccagacttcaaacttccgcgtgcagcctaccgaatccatcgtccgtttcccaaacatcactaacctgtgccctttcggagaggtcttcaacgccacccgcttcgcttccgtgtacgcctggaaccgcaagcgtatctcaaactgcgtcgctgactactccgtgctgtacaactcagcctccttcagcaccttcaagtgctacggagtgtcacccactaagctgaacgacctgtgcttcaccaacgtctacgctgactccttcgtgatccgcggtgacgaggtccgtcagatcgctccaggccagactggaaacatcgccgactacaactacaagctgcctgacgacttcaccggttgcgtcatcgcctggaacagcaacaacctggactctaaagtgggtggcaactacaactacctgtacaggctgttcagaaagtcaaacctgaagcccttcgagcgcgacatcagcactgaaatctaccaggctggttctaccccatgcaacggtgtcaagggcttcaactgctacttccctctgcagtcctacggcttccagcccacttacggtgtgggctaccagccataccgtgtggtcgtgctgagcttcgagctgctgcacgcccctgctactgtgtgcggacccaagaagtctaccaacctggtcaagaacaagtgcgtgaacttcaacttcaacggtctgaccggaactggtgtcctgaccgagagcaacaagaagttcctgcctttccagcagttcggtcgcgacatcgctgacaccactgacgccgtgcgtgaccctcagaccctggaaatcctggacatcactccctgctcattcggaggtgtctccgtgatcactcccggaaccaacacttctaaccaggtcgctgtgctgtaccagggtgtgaactgcaccgaagtcccagtggccatccacgctgaccagctgacccctacttggagggtgtactccaccggcagcaacgtcttccagactagagctggatgcctgatcggtgccgagcacgtcaacaacagctacgaatgcgacatccctatcggcgctggaatctgcgcctcttaccagacccagactaacagcccccagcaggctcagtctgtggcctctcagtcaatcatcgcctacaccatgtcactgggtgtcgaaaactccgtggcttactctaacaactcaatcgccatccctaccaacttcactatcagcgtgaccactgagatcctgcccgtcagcatgaccaagacttctgtggactgcactatgtacatctgcggcgacagcaccgaatgctctaacctgctgctgcagtacggttctttctgcacccagctgaaccgcgctctgactggcatcgccgtggagcaggacaagaacactcaggaagtcttcgctcaggtgaagcaaatctacaagaccccacctatcaaggacttcggcggattcaacttctcccagatcctgccagacccttccaagcccagcaagaggtctttcatcgaggacctgctgttcaacaaggtcactctggccgacgctggtttcatcaagcagtacggcgactgcctgggagacatcgctgctcgcgacctgatctgcgcccagaagttcaacggcctgaccgtgctgcccccactgctgactgacgaaatgatcgctcagtacactagcgccctgctggctggcaccatcacttcaggttggactttcggtgctggtgctgctctgcagatcccattcgctatgcagatggcctaccgtttcaacggaatcggtgtcacccagaacgtgctgtacgagaaccagaagctgatcgctaaccagttcaactcagccatcggcaagatccaggacagcctgagctctactgcctctgctctgggaaagctgcaggacgtcgtgaaccagaacgcccaggctctgaacaccctggtcaagcagctgtcatccaacttcggcgccatcagctctgtgctgaacgacatcctgtccaggctggaccctcccgaggctgaagtccagatcgacaggctgatcactggaagactgcagtcactgcagacctacgtgactcagcagctgatccgcgccgctgaaatccgtgcctccgctaacctggccgctaccaagatgagcgagtgcgtcctgggccagtctaagagagtggacttctgcggcaagggataccacctgatgtcattcccacagtccgcccctcacggagtcgtgttcctgcacgtcacctacgtgcccgctcaggagaagaacttcaccactgccccagctatctgccacgacggcaaggctcacttccctcgcgaaggagtcttcgtgagcaacggcacccactggttcgtcactcagcgtaacttctacgagccccagatcatcaccactgacaacactttcgtgtctggcaactgcgacgtggtcatcggtatcgtcaacaacaccgtgtacgaccctctgcagcccgagctggactcattcaaggaagagctggacaagtacttcaagaaccacacctcccctgacgtcgacctgggtgacatctcaggcatcaacgcctccgtcgtgaacatccagaaggagatcgaccgcctgaacgaagtggctaagaacctgaacgaaagcctgatcgacctgcaggagctgggcaagtacgaacagtacatcaagtggccatggtacatctggctgggattcatcgctggcctcatcgctatcgtgatggtgaccatcatgctgtgctgcatgacttcatgctgctcctgcctgaagggttgctgcagctgcggctcttgctgcaagttcgacgaggacgactctgaaccttcctgaagggagtgaagctgcactacacctaa

SEQ ID NO: 146 - protein, 1267 aa, Artificial Sequence
  modified coronavirus S polypeptide
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 147 - protein, 1254 aa, Artificial Sequence
  modified coronavirus S polypeptide
QCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPGGSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 148 - DNA, 3804 bp, Artificial Sequence
  modified coronavirus S polypeptide
atgttcgtcttcctggtgctgctgcctctggtgtccagccagtgcgtgaacttcaccactaggactcagctgcctcccgcttacaccaactcattcactaggggtgtgtactacccagacaaggtcttccgctcctcagtgctgcactcaactcaggacctgttcctgcctttcttctccaacgtcacctggttccacgctatccacgtgtccggcaccaacggcactaagaggttcgccaaccccgtgctgccattcaacgacggagtctacttcgcttcaaccgagaagtccaacatcatcagaggatggatcttcggcaccactctggacagcaagactcagtctctgctgatcgtcaacaacgctaccaacgtggtcatcaaggtgtgcgaattccagttctgtaacgaccccttcctgggtgtctactaccacaagaacaacaagtcatggatggagtccgaattccgcgtctactccagcgctaacaactgcactttcgagtacgtgtcccagccattcctgatggacctggaaggaaagcagggtaacttcaagaacctgcgcgagttcgtgttcaagaacatcgacggctacttcaagatttacagcaagcacacccccatcaacctggtccgtggcctgccacagggattctctgctctggagcccctggtggacctgccaatcggcatcaacatcaccaggttccagactctgcacagatcctacctgactcccggagactcttcatccggttggaccgctggcgctgccgcttactacgtgggttacctgcagccacgcaccttcctgctgaagtacaacgaaaacggcaccatcactgacgccgtcgactgcgctctggacccactgtcagaaaccaagtgcactctgaagtccttcaccgtggagaagggaatctaccagacttcaaacttccgcgtgcagcctaccgaatccatcgtccgtttcccaaacatcactaacctgtgccctttcggagaggtcttcaacgccacccgcttcgcttccgtgtacgcctggaaccgcaagcgtatctcaaactgcgtcgctgactactccgtgctgtacaactcagcctccttcagcaccttcaagtgctacggagtgtcacccactaagctgaacgacctgtgcttcaccaacgtctacgctgactccttcgtgatccgcggtgacgaggtccgtcagatcgctccaggccagactggaaacatcgccgactacaactacaagctgcctgacgacttcaccggttgcgtcatcgcctggaacagcaacaacctggactctaaagtgggtggcaactacaactacctgtacaggctgttcagaaagtcaaacctgaagcccttcgagcgcgacatcagcactgaaatctaccaggctggttctaccccatgcaacggtgtcaagggcttcaactgctacttccctctgcagtcctacggcttccagcccacttacggtgtgggctaccagccataccgtgtggtcgtgctgagcttcgagctgctgcacgcccctgctactgtgtgcggacccaagaagtctaccaacctggtcaagaacaagtgcgtgaacttcaacttcaacggtctgaccggaactggtgtcctgaccgagagcaacaagaagttcctgcctttccagcagttcggtcgcgacatcgctgacaccactgacgccgtgcgtgaccctcagaccctggaaatcctggacatcactccctgctcattcggaggtgtctccgtgatcactcccggaaccaacacttctaaccaggtcgctgtgctgtaccagggtgtgaactgcaccgaagtcccagtggccatccacgctgaccagctgacccctacttggagggtgtactccaccggcagcaacgtcttccagactagagctggatgcctgatcggtgccgagcacgtcaacaacagctacgaatgcgacatccctatcggcgctggaatctgcgcctcttaccagacccagactaacagcccaggtggttctgtggcctctcagtcaatcatcgcctacaccatgtcactgggtgtcgaaaactccgtggcttactctaacaactcaatcgccatccctaccaacttcactatcagcgtgaccactgagatcctgcccgtcagcatgaccaagacttctgtggactgcactatgtacatctgcggcgacagcaccgaatgctctaacctgctgctgcagtacggttctttctgcacccagctgaaccgcgctctgactggcatcgccgtggagcaggacaagaacactcaggaagtcttcgctcaggtgaagcaaatctacaagaccccacctatcaaggacttcggcggattcaacttctcccagatcctgccagacccttccaagcccagcaagaggtctttcatcgaggacctgctgttcaacaaggtcactctggccgacgctggtttcatcaagcagtacggcgactgcctgggagacatcgctgctcgcgacctgatctgcgcccagaagttcaacggcctgaccgtgctgcccccactgctgactgacgaaatgatcgctcagtacactagcgccctgctggctggcaccatcacttcaggttggactttcggtgctggtgctgctctgcagatcccattcgctatgcagatggcctaccgtttcaacggaatcggtgtcacccagaacgtgctgtacgagaaccagaagctgatcgctaaccagttcaactcagccatcggcaagatccaggacagcctgagctctactgcctctgctctgggaaagctgcaggacgtcgtgaaccagaacgcccaggctctgaacaccctggtcaagcagctgtcatccaacttcggcgccatcagctctgtgctgaacgacatcctgtccaggctggaccctcccgaggctgaagtccagatcgacaggctgatcactggaagactgcagtcactgcagacctacgtgactcagcagctgatccgcgccgctgaaatccgtgcctccgctaacctggccgctaccaagatgagcgagtgcgtcctgggccagtctaagagagtggacttctgcggcaagggataccacctgatgtcattcccacagtccgcccctcacggagtcgtgttcctgcacgtcacctacgtgcccgctcaggagaagaacttcaccactgccccagctatctgccacgacggcaaggctcacttccctcgcgaaggagtcttcgtgagcaacggcacccactggttcgtcactcagcgtaacttctacgagccccagatcatcaccactgacaacactttcgtgtctggcaactgcgacgtggtcatcggtatcgtcaacaacaccgtgtacgaccctctgcagcccgagctggactcattcaaggaagagctggacaagtacttcaagaaccacacctcccctgacgtcgacctgggtgacatctcaggcatcaacgcctccgtcgtgaacatccagaaggagatcgaccgcctgaacgaagtggctaagaacctgaacgaaagcctgatcgacctgcaggagctgggcaagtacgaacagtacatcaagtggccatggtacatctggctgggattcatcgctggcctcatcgctatcgtgatggtgaccatcatgctgtgctgcatgacttcatgctgctcctgcctgaagggttgctgcagctgcggctcttgctgcaagttcgacgaggacgactctgaacctgtcctgaagggagtgaagctgcactacacc

SEQ ID NO: 149 - protein, 1273 aa, Artificial Sequence
  modified coronavirus S polypeptide
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 150 - DNA, 3822 bp, Artificial Sequence
  modified coronavirus S polypeptide
atgttcgtcttcctggtgctgctgcctctggtgtccagccagtgcgtgaacttcaccaaccgcactcagctgcctagcgcttacaccaactctttcactaggggtgtgtactaccccgacaaggtcttccgctcctcagtgctgcactctactcaggacctgttcctgcccttcttctctaacgtcacctggttccacgccatccacgtgagcggcaccaacggcactaagaggttcgacaacccagtgctgcctttcaacgacggtgtctacttcgcttcaaccgagaagtccaacatcatcagaggatggatcttcggcaccactctggacagcaagactcagtctctgctgatcgtcaacaacgccaccaacgtggtcatcaaggtgtgcgaattccagttctgcaactacccattcctgggcgtctactaccacaagaacaacaagtcatggatggagtccgaattccgcgtctactccagcgctaacaactgcactttcgagtacgtgtcccagcctttcctgatggacctggaaggaaagcagggtaacttcaagaacctgtcagagttcgtgttcaagaacatcgacggatacttcaagatttactccaagcacaccccaatcaacctggtccgtgacctgcctcagggtttctcagctctggagccactggtggacctgcctatcggcatcaacatcaccaggttccagactctgctggctctgcacagatcctacctgactccaggtgactcatcttctggatggactgctggagctgctgcttactacgtgggttacctgcagcctcgcaccttcctgctgaagtacaacgaaaacggcaccatcactgacgccgtcgactgcgctctggaccctctgagcgaaaccaagtgcactctgaagtctttcaccgtggagaagggtatctaccagactagcaacttccgcgtgcagcccaccgaatctatcgtccgtttccctaacatcactaacctgtgccccttcggcgaggtcttcaacgccacccgtttcgcttccgtgtacgcctggaaccgcaagcgtatcagcaactgcgtcgctgactactctgtgctgtacaactcagcctccttcagcactttcaagtgctacggtgtgagccctactaagctgaacgacctgtgcttcaccaacgtctacgccgactctttcgtgatccgcggcgacgaggtccgtcagatcgctccaggccagaccggaactatcgccgactacaactacaagctgcctgacgacttcaccggctgcgtcatcgcttggaactcaaacaacctggactccaaagtgggtggcaactacaactacctgtacaggctgttcagaaagtcaaacctgaagcccttcgagagggacatctcaactgaaatctaccaggccggctccaccccatgcaacggtgtcaagggcttcaactgctacttccccctgcagtcctacggattccagccaacttacggtgtgggctaccagccttacagagtggtcgtgctgtcattcgaactcctccacgctcctgctactgtgtgcggaccaaagaagtccaccaacctggtcaagaacaagtgcgtgaacttcaacttcaacggtctgaccggaactggtgtcctgaccgagtcaaacaagaagttcctgcccttccagcagttcggtcgcgacatcgctgacactaccgacgccgtgcgtgacccccagaccctggaaatcctggacatcactccatgcagcttcggaggtgtctctgtgatcactccaggaaccaacacttccaaccaggtcgctgtgctgtaccagggtgtcaactgcaccgaagtccctgtggccatccacgctgaccagctgacccccacttggagggtgtactccaccggcagcaacgtcttccagactagagctggttgcctgatcggcgccgagtacgtgaacaactcatacgaatgcgacatccctatcggcgctggaatctgcgcctcctaccagacccagactaactcaccccagcaggctcagtccgtcgcctctcagtcaatcatcgcttacaccatgagcctgggcgctgaaaactctgtggcctactctaacaactcaatcgccatccccaccaacttcactatcagcgtgaccactgagatcctgccagtctcaatgaccaagacttccgtggactgcactatgtacatctgcggagacagcaccgaatgctctaacctgctgctgcagtacggctctttctgcacccagctgaacagggctctgactggaatcgccgtggagcaggacaagaacactcaggaagtcttcgctcaggtgaagcaaatctacaagacccctcccatcaaggacttcggcggattcaacttctcccagatcctgcctgacccctccaagcccagcaagcgctctttcatcgaggacctgctgttcaacaaggtcaccctggccgacgctggcttcatcaagcagtacggagactgcctgggtgacatcgccgctcgtgacctgatctgcgctcagaagttcaacggactgaccgtgctgccacctctgctgactgacgaaatgatcgcccagtacacttcagccctgctggctggaaccatcacttctggttggaccttcggtgctggtgctgctctgcagatcccattcgctatgcagatggcctaccgcttcaacggaatcggtgtcacccagaacgtgctgtacgagaaccagaagctgatcgctaaccagttcaacagcgccatcggcaagatccaggactcactgagctctactgcctccgctctgggaaagctgcaggacgtcgtgaaccagaacgcccaggctctgaacaccctggtcaagcagctgtcatccaacttcggagctatcagctctgtgctgaacgacatcctctcccgcctggaccctcctgaggctgaagtccagatcgacaggctgatcactggtagactgcagagcctgcagacctacgtgactcagcagctgatccgcgccgctgaaatccgtgcctctgctaacctggctgctatcaagatgtcagagtgcgtcctgggacagtccaagagagtggacttctgcggcaagggataccacctgatgtcattccctcagtccgctccccacggtgtcgtgttcctgcacgtcacctacgtgccagcccaggagaagaacttcaccactgcccctgctatctgccacgacggcaaggctcacttcccccgcgaaggtgtcttcgtgagcaacggcacccactggttcgtcactcagcgtaacttctacgagccacagatcatcaccactgacaacactttcgtgtctggaaactgcgacgtggtcatcggtatcgtcaacaacaccgtgtacgaccccctgcagccagagctggacagcttcaaggaagagctggacaagtacttcaagaaccacacctctcccgacgtggacctgggcgacatcagcggaatcaacgcttctttcgtcaacatccagaaggagatcgaccgtctgaacgaagtggccaagaacctgaacgaatcactgatcgacctgcaggagctgggcaagtacgaacagtacatcaagtggccatggtacatctggctgggtttcatcgctggcctcatcgctatcgtgatggtgaccatcatgctgtgctgcatgacttcatgctgctcctgcctgaagggctgctgcagctgcggatcttgctgcaagttcgacgaggacgactccgaacctgtcctgaagggagtgaagctgcactacacctaa

SEQ ID NO: 151 - protein, 1260 aa, Artificial Sequence
  modified coronavirus S polypeptide
QCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASFVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 152 - protein, 1273 aa, Artificial Sequence
  modified coronavirus S polypeptide
MFVFLVLLPLVSIQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQPYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 153 - protein, 1260 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSCMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVEGFNCYFPLQPYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 154 - protein, 13 aa, Artificial Sequence
  N-terminal signal peptide
MFVFFVLLPLVSS

SEQ ID NO: 155 - protein, 1273 aa, Artificial Sequence
  modified coronavirus S polypeptide
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 156 - protein, 1260 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 157 - protein, 1273 aa, Artificial Sequence
  modified coronavirus S polypeptide
MFVFFVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 158 - protein, 1260 aa, Artificial Sequence
  modified coronavirus S polypeptide
QCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPQQAQSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 159 - protein, 1271 aa, Artificial Sequence
  Recombinant SARS-CoV-2 S Polypeptide
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 160 - protein, 1273 aa, Artificial Sequence
  Recombinant SARS-CoV-2 S Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 161 - protein, 1271 aa, Artificial Sequence
  Recombinant SARS-CoV-2 S Polypeptide
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGITAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 162 - protein, 1273 aa, Artificial Sequence
  Recombinant SARS-CoV-2 S Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 163 - protein, 1274 aa, Artificial Sequence
  Recombinant SARS-CoV-2 S Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVTSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 164 - protein, 1258 aa, Artificial Sequence
  Recombinant SARS-CoV-2 S Polypeptide
QCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 165 - protein, 1260 aa, Artificial Sequence
  Recombinant SARS-CoV-2 S Polypeptide
QCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSWMKSEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSTPCNGVQGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAHEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 166 - protein, 1258 aa, Artificial Sequence
  Recombinant SARS-CoV-2 S Polypeptide
QCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESGVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGITAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 167 - protein, 1260 aa, Artificial Sequence
  Recombinant SARS-CoV-2 S Polypeptide
QCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 168 - protein, 1261 aa, Artificial Sequence
  Recombinant SARS-CoV-2 S Polypeptide
QCVNLTTRTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVTSNHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATKFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHQQAQSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 169 - DNA, 20 bp, Artificial Sequence
  2019-nCoV_N1-F
gaccccaaaatcagcgaaat

SEQ ID NO: 170 - DNA, 24 bp, Artificial Sequence
  2019-nCoV_N1-R
tctggttactgccagttgaatctg

SEQ ID NO: 171 - DNA, 24 bp, Artificial Sequence
  2019-nCoV_N1-P
  misc_feature (1)..(1): 6-Carboxyfluorescein moiety attached
  misc_feature (9)..(10): linked by internal ZEN Quencher moiety
  misc_feature (24)..(24): Iowa Black FQ quencher moiety attached
accccgcattacgtttggtggacc

SEQ ID NO: 172 - DNA, 23 bp, Artificial Sequence
  Sg-N-F
cgatctcttgtagatctgttctc

SEQ ID NO: 173 - DNA, 20 bp, Artificial Sequence
  Sg-N-R
ggtgaaccaagacgcagtat

SEQ ID NO: 174 - DNA, 25 bp, Artificial Sequence
  Sg-N-P
  misc_feature (1)..(1): 6-Carboxyfluorescein moiety attached
  misc_feature (9)..(10): linked by internal ZEN Quencher moiety
  misc_feature (25)..(25): Iowa Black FQ quencher moiety attached
taaccagaatggagaacgcagtggg

The invention claimed is:

1. An immunogenic composition comprising:
- (a) a severe acute respiratory syndrome coronavirus-2 S (SARS-COV-2 S) glycoprotein in the form of a detergent-core nanoparticle, wherein the detergent is a non-ionic detergent, and wherein the SARS-COV-2 S glycoprotein comprises an inactivated furin cleavage site having the amino acid sequence QQAQ (SEQ ID NO: 7) and proline at each of amino acids 973 and 974, as numbered with respect to a polypeptide having the sequence of SEQ ID NO: 2;
- (b) at least three hemagglutinin (HA) glycoproteins, wherein each HA glycoprotein is from a different influenza strain, and wherein each HA glycoprotein is in the form of a detergent-core nanoparticle or in the form of a HaSMaN (hemagglutinin saponin matrix nanoparticle); and
- (c) a pharmaceutically acceptable buffer;

wherein the composition comprises from 20 μg to about 65 μg of HA glycoprotein per strain and from about 5 μg to about 50 μg of SARS-COV-2 S glycoprotein.

2. The immunogenic composition of claim 1, wherein the composition comprises at least 20 μg of SARS-COV-2 S glycoprotein.

3. The immunogenic composition of claim 1, comprising: at least one HA glycoprotein in the form of a detergent-core nanoparticle and at least one HA glycoprotein in the form of a HaSMaN.

4. The immunogenic composition of claim 3, wherein the HA glycoprotein of the detergent-core nanoparticle is from a Type B influenza strain.

5. The immunogenic composition of claim 3, wherein the HA glycoprotein of the HaSMaN is from a Type A influenza strain.

6. The immunogenic composition of claim 1, comprising up to 4 HA glycoproteins.

7. The immunogenic composition of claim 1, wherein each detergent-core nanoparticle or HaSMaN comprises a HA glycoprotein from a single influenza strain.

8. The immunogenic composition of claim 1, comprising an adjuvant.

9. The immunogenic composition of claim 8, wherein the adjuvant is a saponin adjuvant.

10. The immunogenic composition of claim 9, wherein the saponin adjuvant comprises at least two iscom particles, wherein:

the first iscom particle comprises fraction A of *Quillaja Saponaria Molina* and not fraction C of *Quillaja Saponaria Molina*; and the second iscom particle comprises fraction C of *Quillaja Saponaria Molina* and not fraction A of *Quillaja Saponaria Molina*.

11. The immunogenic composition of claim 10, wherein fraction A of *Quillaja Saponaria Molina* accounts for 50-96% by weight and fraction C of *Quillaja Saponaria Molina* accounts for the remainder, respectively, of the sum of the weights of fraction A of *Quillaja Saponaria Molina* and fraction C of *Quillaja Saponaria Molina* in the adjuvant.

12. The immunogenic composition of claim 10, wherein fraction A of *Quillaja Saponaria Molina* and fraction C of *Quillaja Saponaria Molina* account for about 85% by weight and about 15% by weight, respectively, of the sum of the weights of fraction A of *Quillaja Saponaria Molina* and fraction C of *Quillaja Saponaria Molina* in the adjuvant.

13. The immunogenic composition of claim 9, comprising about 50 μg or about 75 μg saponin adjuvant.

14. The immunogenic composition of claim 1, wherein the detergent is PS80.

15. The immunogenic composition of claim 1, wherein the pharmaceutically acceptable buffer comprises (i) sodium phosphate at about 25 mM; (ii) sodium chloride at about 150 mM; (iii) arginine hydrochloride at about 100 mM; (iv) trehalose at about 5%; wherein the composition pH is at about 7.5.

16. The immunogenic composition of claim 1, wherein the SARS-CoV-2 S glycoprotein comprises:

(i) an S1 subunit with an inactivated furin cleavage site, wherein the S1 subunit comprises an N-terminal domain (NTD), a receptor binding domain (RBD), subdomains 1 and 2 (SD1/2), wherein the inactivated furin cleavage site has an amino acid sequence of QQAQ (SEQ ID NO: 7);

wherein the NTD optionally comprises one or more modifications selected from the group consisting of:

(a) deletion of one or more amino acids selected from the group consisting of amino acid 56, 57, 131, 132, 144, 145, 228, 229, 230, 231, 234, 235, 236, 237, 238, 239, 240 and combinations thereof;

(b) insertion of 1, 2, 3, or 4 amino acids after amino acid 132; and (c) mutation of one or more amino acids selected from the group consisting of amino acid 5, 6, 7, 13, 51, 53, 56, 57, 62, 63, 67, 82, 125, 129, 131, 132, 133, 139, 143, 144, 145, 177, 200, 201, 202, 209, 229, 233, 240, 245, and combinations thereof;

wherein the RBD optionally comprises mutation of one or more amino acids selected from the group consisting of amino acid 333, 404, 419, 426, 439, 440, 464, 465, 471, 477, 481, 488, and combinations thereof;

wherein the SD1/2 domain optionally comprises mutation of one or more amino acids selected from the group consisting of 557, 600, 601, 642, 664, 668, and combinations thereof; and (ii) an S2 subunit, wherein amino acids 973 and 974 are proline, wherein the S2 subunit optionally comprises one or more modifications selected from the group consisting of:

(a) deletion of one or more amino acids from 676-685, 676-702, 702-711, 775-793, 806-815 and combinations thereof;

(b) mutation of one or more amino acids selected from the group consisting of 688, 703, 846, 875, 937, 969, 1014, 1058, 1105, and 1163 and combinations thereof; and (c) deletion of one or more amino acids from the TMCT;

wherein the amino acids of the SARS-COV-2 S glycoprotein are numbered with respect to a polypeptide having the sequence of SEQ ID NO: 2.

17. The immunogenic composition of claim 1, wherein the SARS-CoV-2 S glycoprotein comprises an amino acid sequence with at least 95% identity to SEQ ID NO: 87.

18. The immunogenic composition of claim 1, wherein the SARS-CoV-2 S glycoprotein comprises the amino acid sequence of SEQ ID NO: 87.

19. A method of stimulating an immune response against SARS-COV-2, a heterogeneous SARS-COV-2 strain, an influenza virus, or a combination thereof in a subject comprising administering the immunogenic composition of claim 1.

20. The method of claim 19, wherein at least 20 μg of SARS-COV-2 S glycoprotein is administered.

21. The method of claim 19, comprising administering an initial dose of the immunogenic composition and a boost dose of the immunogenic composition 56 days later.

22. The method of claim 19, wherein the immunogenic composition comprises up to 4 HA glycoproteins.

23. The method of claim 19, wherein each HA glycoprotein is in the form of a nanoparticle.

24. The method of claim 23, wherein each nanoparticle comprises a HA glycoprotein from a single influenza strain.

25. The method of claim 19, wherein the SARS-COV-2 S glycoprotein of the immunogenic composition comprises:

(i) an S1 subunit with an inactivated furin cleavage site, wherein the S1 subunit comprises an N-terminal domain (NTD), a receptor binding domain (RBD), subdomains 1 and 2 (SD1/2), wherein the inactivated furin cleavage site has an amino acid sequence of QQAQ (SEQ ID NO: 7);

wherein the NTD optionally comprises one or more modifications selected from the group consisting of:

(a) deletion of one or more amino acids selected from the group consisting of amino acid 56, 57, 131, 132, 144, 145, 228, 229, 230, 231, 234, 235, 236, 237, 238, 239, 240 and combinations thereof;

(b) insertion of 1, 2, 3, or 4 amino acids after amino acid 132; and (c) mutation of one or more amino acids selected from the group consisting of amino acid 5, 6, 7, 13, 51, 53, 56, 57, 62, 63, 67, 82, 125, 129, 131, 132, 133, 139, 143, 144, 145, 177, 200, 201, 202, 209, 229, 233, 240, 245, and combinations thereof;

wherein the RBD optionally comprises mutation of one or more amino acids selected from the group consisting of amino acid 333, 404, 419, 426, 439, 440, 464, 465, 471, 477, 481, 488, and combinations thereof;

wherein the SD1/2 domain optionally comprises mutation of one or more amino acids selected from the group consisting of 557, 600, 601, 642, 664, 668, and combinations thereof; and (ii) an S2 subunit, wherein amino acids 973 and 974 are proline, wherein the S2 subunit optionally comprises one or more modifications selected from the group consisting of:

(a) deletion of one or more amino acids from 676-685, 676-702, 702-711, 775-793, 806-815 and combinations thereof;

(b) mutation of one or more amino acids selected from the group consisting of 688, 703, 846, 875, 937, 969, 1014, 1058, 1105, and 1163 and combinations thereof; and (c) deletion of one or more amino acids from the TMCT; wherein the amino acids of the SARS-COV-2 S glycoprotein are numbered with respect to a polypeptide having the sequence of SEQ ID NO: 2.

26. The method of claim 19, wherein the SARS-COV-2 S glycoprotein of the immunogenic composition comprises modifications compared to a native SARS-COV-2 S glycoprotein, wherein:

(i) the first modification is an inactivated furin cleavage site consisting of mutation of amino acids RRAR (SEQ ID NO: 6); and (ii) the second modification is mutation of amino acids 973 and 974 to proline;

wherein the amino acids are numbered according to SEQ ID NO: 2.

27. The method of claim 19, wherein the SARS-COV-2 S glycoprotein comprises an amino acid sequence with at least 95% identity to SEQ ID NO: 87.

28. The method of claim 19, wherein the SARS-COV-2 S glycoprotein comprises the amino acid sequence of SEQ ID NO: 87.

29. The method of claim 19, wherein the immunogenic composition comprises a saponin adjuvant.

* * * * *